United States Patent
Shak et al.

(10) Patent No.: US 10,260,104 B2
(45) Date of Patent: *Apr. 16, 2019

(54) METHOD FOR USING GENE EXPRESSION TO DETERMINE PROGNOSIS OF PROSTATE CANCER

(71) Applicant: GENOMIC HEALTH, INC., Redwood City, CA (US)

(72) Inventors: Steven Shak, Hillsborough, CA (US); Frederick L. Baehner, San Francisco, CA (US); Tara Maddala, Sunnyvale, CA (US); Mark Lee, Los Altos Hills, CA (US); Robert J. Pelham, Belmont, CA (US); Wayne Cowens; Diana Cherbavaz, San Francisco, CA (US); Michael C. Kiefer, Walnut Creek, CA (US); Michael Crager, Menlo Park, CA (US); Audrey Goddard, San Francisco, CA (US); Joffre B. Baker, Montara, CA (US)

(73) Assignee: Genomic Health, Inc., Redwood City, CA (US)

( * ) Notice: Subject to any disclaimer, the term of this patent is extended or adjusted under 35 U.S.C. 154(b) by 205 days.

This patent is subject to a terminal disclaimer.

(21) Appl. No.: 14/887,605

(22) Filed: Oct. 20, 2015

(65) Prior Publication Data

US 2016/0097105 A1    Apr. 7, 2016

Related U.S. Application Data

(63) Continuation of application No. 13/190,391, filed on Jul. 25, 2011, now abandoned.

(60) Provisional application No. 61/368,217, filed on Jul. 27, 2010, provisional application No. 61/414,310, filed on Nov. 16, 2010, provisional application No. 61/485,536, filed on May 12, 2011.

(51) Int. Cl.
  *G06F 19/00* (2018.01)
  *C12Q 1/6886* (2018.01)

(52) U.S. Cl.
  CPC .......... *C12Q 1/6886* (2013.01); *G06F 19/00* (2013.01); *C12Q 2600/118* (2013.01); *C12Q 2600/158* (2013.01); *C12Q 2600/178* (2013.01)

(58) Field of Classification Search
  None
  See application file for complete search history.

(56) References Cited

U.S. PATENT DOCUMENTS

| | | | |
|---|---|---|---|
| 5,712,097 A | 1/1998 | Kern et al. | |
| 6,190,857 B1 | 2/2001 | Ralph et al. | |
| 6,300,060 B1 | 10/2001 | Kantoff et al. | |
| 6,692,916 B2 | 2/2004 | Bevilacqua et al. | |
| RE38,490 E | 4/2004 | Thompson | |
| 6,960,439 B2 | 11/2005 | Bevilacqua et al. | |
| 6,964,850 B2 | 11/2005 | Bevilacqua et al. | |
| 7,018,837 B2 | 3/2006 | Filvaroff et al. | |
| 7,022,474 B2 | 4/2006 | Nezu et al. | |
| 7,229,774 B2 | 6/2007 | Chinnaiyan et al. | |
| 7,695,913 B2 | 4/2010 | Cowens et al. | |
| 7,943,306 B2 | 5/2011 | Chang et al. | |
| 7,957,909 B2 | 6/2011 | Bevilacqua et al. | |
| 8,067,178 B2 | 11/2011 | Baker et al. | |
| 8,114,597 B2 | 2/2012 | Liew | |
| 2002/0173461 A1* | 11/2002 | Pennica | A01K 67/0276 514/1.5 |
| 2003/0017513 A1 | 1/2003 | Khosravi et al. | |
| 2003/0087818 A1 | 5/2003 | Jiang et al. | |
| 2003/0113743 A1 | 6/2003 | Slawin et al. | |
| 2003/0138793 A1 | 7/2003 | Su et al. | |
| 2003/0148410 A1 | 8/2003 | Berger et al. | |
| 2003/0170713 A1 | 9/2003 | Srivastava et al. | |
| 2003/0198970 A1 | 10/2003 | Roberts | |
| 2003/0207808 A1 | 11/2003 | Savitzky et al. | |
| 2003/0215835 A1 | 11/2003 | Sun et al. | |
| 2004/0053317 A1 | 3/2004 | Glinskii | |
| 2004/0203012 A1 | 10/2004 | Diamandis | |
| 2005/0048542 A1 | 3/2005 | Baker et al. | |
| 2005/0112705 A1 | 5/2005 | Bracco et al. | |
| 2005/0191673 A1 | 9/2005 | Schlegel et al. | |
| 2005/0260646 A1 | 11/2005 | Baker et al. | |
| 2005/0282170 A1 | 12/2005 | Fradet et al. | |
| 2006/0051763 A1 | 3/2006 | Loukola et al. | |

(Continued)

FOREIGN PATENT DOCUMENTS

| | | |
|---|---|---|
| JP | 2005211023 A | 8/2005 |
| WO | WO-9700449 A1 | 1/1997 |

(Continued)

OTHER PUBLICATIONS

Whitehead (Genome Biology 2005 vol. 6 Issue 2 Article R13).*

(Continued)

*Primary Examiner* — Amanda Haney
(74) *Attorney, Agent, or Firm* — Genomic Health/McNeil Baur PLLC

(57) ABSTRACT

The present disclosure includes assays that involve measurement of expression levels of prognostic biomarkers, or co-expressed biomarkers, from a biological sample obtained from a prostate cancer patient, and analysis of the measured expression levels to provide information concerning the likely prognosis for the patient, and likelihood that the patient will have a recurrence of prostate cancer, or to classify the tumor by likelihood of clinical outcome or TMPRSS2 fusion status.

11 Claims, 1 Drawing Sheet
Specification includes a Sequence Listing.

(56) References Cited

U.S. PATENT DOCUMENTS

| | | |
|---|---|---|
| 2006/0088823 A1 | 4/2006 | Haab et al. |
| 2006/0166230 A1 | 7/2006 | Baker et al. |
| 2006/0281122 A1 | 12/2006 | Bryant et al. |
| 2006/0292572 A1 | 12/2006 | Stuart et al. |
| 2006/0292610 A1 | 12/2006 | Shen et al. |
| 2007/0048738 A1 | 3/2007 | Donkena et al. |
| 2007/0059697 A1 | 3/2007 | Strovel et al. |
| 2007/0099209 A1 | 5/2007 | Clarke et al. |
| 2007/0105133 A1 | 5/2007 | Clarke et al. |
| 2007/0212702 A1 | 9/2007 | Tomlins et al. |
| 2007/0218512 A1 | 9/2007 | Strongin et al. |
| 2007/0224596 A1 | 9/2007 | Nacht et al. |
| 2007/0253953 A1 | 11/2007 | Chen et al. |
| 2007/0275398 A1 | 11/2007 | Kiefer et al. |
| 2008/0015448 A1 | 1/2008 | Keely et al. |
| 2008/0131887 A1 | 6/2008 | Stephan et al. |
| 2008/0171352 A1 | 7/2008 | Goix et al. |
| 2008/0213791 A1 | 9/2008 | Freije et al. |
| 2008/0222741 A1 | 9/2008 | Chinnaiyan |
| 2008/0254481 A1 | 10/2008 | Love et al. |
| 2008/0269064 A1 | 10/2008 | Ramael |
| 2008/0275652 A1 | 11/2008 | Sotiriou et al. |
| 2009/0023149 A1 | 1/2009 | Knudsen |
| 2009/0047694 A1 | 2/2009 | Shuber |
| 2009/0048266 A1 | 2/2009 | Heise et al. |
| 2009/0098538 A1 | 4/2009 | Glinsky |
| 2009/0123439 A1 | 5/2009 | Yun et al. |
| 2009/0142262 A1 | 6/2009 | Salceda et al. |
| 2009/0170075 A1 | 7/2009 | Petrovics et al. |
| 2009/0215709 A1 | 8/2009 | Van Criekinge et al. |
| 2009/0233279 A1 | 9/2009 | Glinskii |
| 2009/0258795 A1 | 10/2009 | Cowens et al. |
| 2009/0297525 A1 | 12/2009 | Depinho et al. |
| 2009/0298082 A1 | 12/2009 | Klee et al. |
| 2009/0305277 A1 | 12/2009 | Baker et al. |
| 2009/0318775 A1 | 12/2009 | Michelson et al. |
| 2010/0015620 A1 | 1/2010 | Strovel et al. |
| 2010/0048414 A1 | 2/2010 | Weaver et al. |
| 2010/0113290 A1 | 5/2010 | Klass et al. |
| 2010/0120788 A1 | 5/2010 | Wang et al. |
| 2010/0124745 A1 | 5/2010 | Liew |
| 2010/0130377 A1 | 5/2010 | Vasmatzis et al. |
| 2010/0143247 A1 | 6/2010 | Fenske et al. |
| 2010/0227317 A1* | 9/2010 | Thomson Okatsu .................. C12Q 1/6886 435/6.12 |
| 2010/0233187 A1 | 9/2010 | Chan et al. |
| 2010/0233732 A1 | 9/2010 | Bates et al. |
| 2010/0233961 A1 | 9/2010 | Holden et al. |
| 2010/0267032 A1 | 10/2010 | Baker et al. |
| 2010/0291573 A1 | 11/2010 | Cowens et al. |
| 2010/0293130 A1 | 11/2010 | Stephan et al. |
| 2010/0297657 A1 | 11/2010 | Chinnaiyan |
| 2010/0303795 A1* | 12/2010 | Sorensen ............ A61K 31/192 424/94.6 |
| 2011/0039269 A1 | 2/2011 | Cowens et al. |
| 2011/0039271 A1 | 2/2011 | Cowens et al. |
| 2011/0059447 A1 | 3/2011 | Liew |
| 2011/0097759 A1 | 4/2011 | Cowens et al. |
| 2011/0111421 A1 | 5/2011 | Cowens et al. |
| 2011/0123990 A1 | 5/2011 | Baker et al. |
| 2011/0124003 A1 | 5/2011 | Ralph |
| 2011/0136683 A1 | 6/2011 | Davicioni |
| 2011/0153534 A1 | 6/2011 | Chudin et al. |
| 2011/0171633 A1 | 7/2011 | Cowens et al. |
| 2011/0236903 A1 | 9/2011 | McClelland et al. |
| 2011/0265197 A1 | 10/2011 | Depinho et al. |
| 2012/0028264 A1 | 2/2012 | Shak et al. |
| 2012/0040842 A1 | 2/2012 | Baker et al. |
| 2012/0136583 A1 | 5/2012 | Lazar et al. |
| 2012/0171688 A1 | 7/2012 | Cowens et al. |

FOREIGN PATENT DOCUMENTS

| | | |
|---|---|---|
| WO | WO-9802748 A1 | 1/1998 |
| WO | WO-9904238 A2 | 1/1999 |
| WO | WO-9945398 A1 | 9/1999 |
| WO | WO-9964626 A2 | 12/1999 |
| WO | WO-9964627 A2 | 12/1999 |
| WO | 00/50899 A1 | 8/2000 |
| WO | WO-0050899 A1 | 8/2000 |
| WO | WO-0136674 A2 | 5/2001 |
| WO | WO-0231209 A2 | 4/2002 |
| WO | WO-0237113 A2 | 5/2002 |
| WO | WO-03050243 A2 | 6/2003 |
| WO | 2003/053223 A2 | 7/2003 |
| WO | 03/089932 A1 | 10/2003 |
| WO | WO-03089932 A1 | 10/2003 |
| WO | WO-2004053106 A2 | 6/2004 |
| WO | WO-2004077942 A2 | 9/2004 |
| WO | 2014/108896 A2 | 12/2004 |
| WO | WO-2005008213 A2 | 1/2005 |
| WO | WO-2005012875 A2 | 2/2005 |
| WO | WO-2005068655 A2 | 7/2005 |
| WO | WO-2005076005 A2 | 8/2005 |
| WO | WO-2005083128 A2 | 9/2005 |
| WO | WO-2005117943 A2 | 12/2005 |
| WO | WO-2005119260 A2 | 12/2005 |
| WO | WO-2006005043 A2 | 1/2006 |
| WO | WO-2006028655 A2 | 3/2006 |
| WO | WO-2006066240 A2 | 6/2006 |
| WO | WO-2006105642 A1 | 10/2006 |
| WO | WO-2006124836 A1 | 11/2006 |
| WO | WO-2007070621 A2 | 6/2007 |
| WO | WO-2007072225 A2 | 6/2007 |
| WO | WO-2007075672 A2 | 7/2007 |
| WO | WO-2007082099 A2 | 7/2007 |
| WO | WO-2007140352 A2 | 12/2007 |
| WO | WO-2008036717 A2 | 3/2008 |
| WO | WO-2008046510 A1 | 4/2008 |
| WO | WO-2008048570 A2 | 4/2008 |
| WO | WO-2008067065 A2 | 6/2008 |
| WO | WO-2008077165 A1 | 7/2008 |
| WO | WO-2008122447 A2 | 10/2008 |
| WO | WO-2008141275 A1 | 11/2008 |
| WO | WO-2008153743 A2 | 12/2008 |
| WO | WO-2009021338 A1 | 2/2009 |
| WO | WO-2009049966 A2 | 4/2009 |
| WO | WO-2009051734 A1 | 4/2009 |
| WO | WO-2009056862 A2 | 5/2009 |
| WO | WO-2009068409 A1 | 6/2009 |
| WO | WO-2009068423 A2 | 6/2009 |
| WO | WO-2009070767 A2 | 6/2009 |
| WO | WO-2009089521 A2 | 7/2009 |
| WO | WO-2009105154 A2 | 8/2009 |
| WO | WO-2009105640 A2 | 8/2009 |
| WO | WO-2009118204 A2 | 10/2009 |
| WO | WO-2009124251 A1 | 10/2009 |
| WO | WO-2009126122 A1 | 10/2009 |
| WO | WO-2009132257 A2 | 10/2009 |
| WO | WO-2009138392 A1 | 11/2009 |
| WO | WO-2009139915 A2 | 11/2009 |
| WO | WO-2009140741 A1 | 11/2009 |
| WO | WO-2009143603 A1 | 12/2009 |
| WO | WO-2009144460 A1 | 12/2009 |
| WO | WO-2009149166 A2 | 12/2009 |
| WO | WO-2010003773 A1 | 1/2010 |
| WO | WO-2010006048 A2 | 1/2010 |
| WO | WO-2010009337 A2 | 1/2010 |
| WO | WO-2010011310 A1 | 1/2010 |
| WO | WO-2010028820 A2 | 3/2010 |
| WO | WO-2010046530 A1 | 4/2010 |
| WO | WO-2010048278 A1 | 4/2010 |
| WO | WO-2010056351 A2 | 5/2010 |
| WO | WO-2010056993 A2 | 5/2010 |
| WO | WO-2010063454 A1 | 6/2010 |
| WO | WO-2010065940 A1 | 6/2010 |
| WO | WO-2010080702 A2 | 7/2010 |
| WO | WO-2010080933 A1 | 7/2010 |
| WO | WO-2010083252 A2 | 7/2010 |
| WO | WO-2010086389 A1 | 8/2010 |

(56) References Cited

FOREIGN PATENT DOCUMENTS

| WO | WO-2010096734 A2 | 8/2010 |
|---|---|---|
| WO | WO-2010099577 A1 | 9/2010 |
| WO | WO-2010118520 A1 | 10/2010 |
| WO | WO-2010119126 A2 | 10/2010 |
| WO | WO-2010127399 A1 | 11/2010 |
| WO | WO-2010129965 A1 | 11/2010 |
| WO | WO-2011039734 A2 | 4/2011 |

OTHER PUBLICATIONS

Nakagawa (PloS ONE May 2008 vol. 3 Issue 5 e2318 pp. 1-14).*
Lapointe (PNAS Jan. 20, 2004 vol. 101 No. 3 pp. 811-816).*
Edwards (British Journal of Cancer 2005 vol. 92 pp. 376-381).*
Erickson (Nature Protocols vol. 4 No. 6 May 21, 2009 pp. 902-922).*
Tomlins (Nature Genetics vol. 39 No. Jan. 1, 2007 pp. 41-51).*
Singh (Cancer Letters 237 vol. 2006 pp. 298-304).*
Barwick (British Journal of Cancer Jan. 12, 2010 vol. 102 pp. 570-576).*
Ornish (PNAS Jun. 17, 2008 vol. 105 No. 24 pp. 8369-8374).*
Cheville (Journal of Clinical Oncology vol. 26 No. 24 Aug. 20, 2008 pp. 3930-3936).*
International Search Report and Written Opinion for Application No. PCT/US2013/023409, dated Jun. 7, 2013, 12 pages.
Nishidate T., et al., "Genome-wide Gene-expression Profiles of Breast-cancer Cells Purified with Laser Microbeam Microdissection: Identification of Genes Associated with Progression and Metastasis," International Journal of Oncology, 2004, vol. 25 (4), pp. 797-819.
Peters D., et al., "Genome-Wide Transcriptional Analysis of Carboplatin Response in Chemosensitive and Chemoresistant Ovarian Cancer Cells," Molecular Cancer Therapeutics, 2005, vol. 4 (10), pp. 1605-1616.
Shen R., et al., "Prognostic Meta-signature of Breast Cancer Developed by Two-stage Mixture Modeling of Microarray Data," BMC Genomics, 2004, vol. 5 (1), pp. 94.
Taioli E., et al., "Multi-institutional Prostate Cancer Study of Genetic Susceptibility in Populations of African Descent," Carcinogenesis, 2011, vol. 32 (9), pp. 1361-1365.
True L., et al., "A Molecular Correlate to the Gleason Grading System for Prostate Adenocarcinoma," Proceedings of the National Academy of Sciences, 2006, vol. 103 (29), pp. 10991-10996.
Turashvili G., et al., "Novel Markers for Differentiation of Lobular and Ductal Invasive Breast Carcinomas by Laser Microdissection and Microarray Analysis," BMC Cancer, 2007, vol. 7, pp. 55.
Vaarala M., "Differential Gene Expression in Prostate Cancer," Biocenter Oulu, 2000.
Aaltomaa., et al., "Expression and Prognostic Value of CD44 Standard and Variant v3 and v6 Isoforms in Prostate Cancer," Eur Urol., 2001, vol. 39, pp. 138-144.
Abrahams., et al., "Distinguishing Atrophy and High-Grade Prostatic Intraepithelial Neoplasia From Prostatic Adenocarcinoma With and Without Previous Adjuvant Hormone Therapy With the Aid of Cytokeratin 5/6," Am J Clin Pathol, 2003, vol. 120, pp. 368-376.
Abrahams., et al., "Validation of Cytokeratin in 5/6 as an Effective Substitute for Keratin 903 in the Differentiation of Benign From Malignant Glands in Prostate Needle Biopsies," Histopathology, 2002, vol. 41, pp. 35-41.
Aitchison A.A., et al., "Promoter Methylation Correlates with Reduced Smad4 Expression in Advanced Prostate Cancer," Prostate, 2008, vol. 68 (6), pp. 661-674.
Anders M., et al., "Microarray Meta-analysis Defines Global Angiogenesis-related Gene Expression Signatures in Human Carcinomas," Molecular Carcinogenesis, 2011.
Aoyagi., et al., "Specific Transcription Factors Prognostic for Prostate Cancer Progression," Clin Cancer Res, 1998, vol. 4, pp. 2153-2160.
Barwick B.G., et al., "Prostate Cancer Genes Associated with TMPRSS2-ERG Gene Fusion and Prognostic of Biochemical Recurrence in Multiple Cohorts," British Journal of Cancer, 2010, vol. 102 (3), pp. 570-576.
Bibikova., et al., "Expression Signatures That Correlated With Gleason Score and Relapse in Prostate Cancer," Genomics, 2007, vol. 89 (6), pp. 666-672, available at www.sciencedirect.com.
Brewster., et al., "Preoperative p53, bcl-2, CD44 and E-cadherin Immunohistochemistry as Predictors of Biochemical Relapse After Radical Prostatectomy," J Urol., 1999, vol. 161, pp. 1238-1243.
Chan E., et al., "Integrating Transcriptomics and Proteomics," G & P Magazine, 2006, vol. 6 (3), pp. 20-26.
Chan., et al., "Insulin-Like Growth Factor-I (IGF-I) and IGF Binding Protein-3 as Predictors of Advanced-Stage Prostate Cancer," Journal of Nat'l Cancer Institute, 2002, vol. 94, pp. 1-8.
Cheville J.C., et al., "Gene Panel Model Predictive of Outcome in Men at High-risk of Systemic Progression and Death from Prostate Cancer After Radical Retropubic Prostatectomy," Journal of Clinical Oncology, 2008, vol. 26 (24), pp. 3930-3936.
Chiang et al., "Human Kallikrein-2 Gene Polymorphism is Associated with the Occurrence of Prostate Cancer", Journal of Pathology, 2005, vol. 173(2), pp. 429-432.
Clarke R.A., et al., "Markers for Detection of Prostate Cancer," Cancers, 2010, vol. 2 (2), pp. 1125-1154.
Creighton, "Multiple Oncogenic Pathway Signatures Show Coordinate Expression Patterns in Human Prostate Tumors," PloS One, 2008, vol. 3 (3), 8 pages, online publication at milw.plosone.ora.
Davies et al., "Growth Factor Receptors and Oncogene Expression in Prostate Cells," Am J Clin Oncol., 1988, vol. 11 (2), pp. S1-S7.
DeMarzo., et al., "CD44 and CD44v6 Downregulation in Clinical Prostatic Carcinoma: Relation to Gleason Grade and Cytoarchitecture," Prostate, 1998, vol. 34, pp. 162-168.
Diamandis., et al., The New Human Kallikrein Gene Family: Implications in Carcinogenesis, TEM, 2000, vol. 11 (2), pp. 54-60.
Edwards., et al., "Gene Amplifications Associated With the Development of Hormone-Resistant Prostate Cancer," Clin Cancer Res, 2003, vol. 9, pp. 5271-5281, downloaded from d:ncaner;es.aacr;o:rnas ug on Feb. 15, 2011.
Edwards., et al., "The Role of c-Jun and C-Fos Expression in Androgen-Independent Prostate Cancer," J Pathol, 2004, vol. 2, pp. 153-158.
Ekici., et al., "Determination of Prognosis in Patients With Prostate Cancer Treated With Radical Prostatectomy: Prognostic Value of CD44v6 Score," J Urol., 2002, vol. 167, pp. 2037-2041.
Eid., et al., "Expression of Early Growth Response Genes in Human Prostate Cancer," Cancer Res, 1998, vol. 58, pp. 2461-2468, downloaded from d:ncancerres.aacriournas org on Feb. 10, 2011.
Extended European Search Report for EP Application No. 15152517.7, dated May 18, 2015, 7 pages.
Extended European Search Report for European Application No. 11813024.4, dated Dec. 2, 2013, 5 pages.
Gavrilov., et al., "Expression of Urokinase Plasminogen Activator and Receptor in Conjunction With the ets Family and AP-1 Complex Transcription Factors in High Grade Prostate Cancers," Eur J Cancer, 2001, vol. 37, pp. 1033-1040.
Glinsky G.V., et al., "Gene Expression Profiling Predicts Clinical Outcome of Prostate Cancer," Journal of Clinical Investigation, 2004, vol. 113 (6), pp. 913-923.
Goldstein, "Immunophenotypic Characterization of 225 Prostate Adenocarcinomas With Intermediate or High Gleason Scores," Am J Clin Pathol, 2002, vol. 117, pp. 471-477.
Graff., et al., "Integrin-linked Kinase Expression Increases With Prostate Tumor Grade," Clin Can Res, 2001, vol. 7, pp. 1987-1991.
Gunia., et al., "Expression of CD44s in Incidental Prostate Cancer is More Strongly Associated With Gleason Scores on Subsequent Radical Prostatectomies Than Conventional Prognostic Parameters," Pathobiology, 2009, vol. 76, pp. 286-292.
Haese et al., "The Role of Human Glandular Kallikrein 2 for Prediction of Pathologically Organ Confined Prostate Cancer," The Prostate, 2003, vol. 54(3), pp. 181-186.
Hale., et al., "Zinc a-2-Glycoprotein is Expressed by Malignant Prostatic Epithelium and May Serve as a Potential Serum Marker for Prostate Cancer," Clin Can Res, 2001, vol. 7, pp. 846-853.

(56) References Cited

OTHER PUBLICATIONS

Horvath., et al., "Membranous Expression of Secreted Frizzled-Related Protein 4 Predicts for Good Prognosis in Localized Prostate Cancer and Inhibits PC3 Cellular Proliferation in Vitro," Clin Can Res, 2004, vol. 10, pp. 615-625.

Horvath L.G., et al., "Loss of BMP2, Smad8 and Smad4 Expression in Prostate Cancer Progression," Prostate, 2004, vol. 59 (3), pp. 234-242.

Hoshikawa Y., et al., "Hypoxia Induces Different Genes in the Lungs of Rats Compared with Mice," Physiological Genomics, 2003, vol. 12 (3), pp. 209-219.

Humphrey, "Gleason Grading and Prognostic Factors in Carcinoma of the Prostate," Modern Pathology, 2004, vol. 17, pp. 292-306.

International Search Report and Written Opinion for Application No. PCT/US2011/045253, dated Feb. 27, 2012, 13 pages.

Isler., et al., "Genomic Organization and Chromosomal Mapping of SPARC-like 1, a Gene Down Regulated in Cancers," Int J Oncol., 2001, vol. 18, pp. 521-526.

Kallakury., et al., "Co-Downregulation of Cell Adhesion Proteins Alpha- and beta-catenins, p120CTN, E-cadherin, and CD44 in Prostatic Adenocarcinomas," Hum Pathol, 2001, vol. 32, pp. 849-855.

Khuntia D., et al., "Recurrence-free Survival Rates After External-beam Radiotherapy for Patients with Clinical T1-T3 Prostate Carcinoma in the Prostate-specific Antigen Era: What Should We Expect?," Cancer, 2004, vol. 100 (6), pp. 1283-1292.

Kim., et al., "The Retinoic Acid Synthesis Gene ALDH1 a2 Is a Candidate Tumor Suppressor in Prostate Cancer," Cancer Res, 2005, vol. 65, pp. 8118-8124.

Kristiansen et al., "ALCAM/CD166 Is Up-Regulated in Low-Grade Prostate Cancer and Progressively Lost in High-Grade Lesions", The Prostate, vol. 54, 2003, pp. 34-43.

Kristiansen G., et al., "Expression Profiling of Microdissected Matched Prostate Cancer Samples Reveals CD166/MEMD and CD24 as New Prognostic Markers for Patient Survival," Journal of Pathology, 2005, vol. 205 (3), pp. 359-376.

Kube D.M., et al., "Optimization of Laser Capture Microdissection and RNA Amplification for Gene Expression Profiling of Prostate Cancer," BMC Molecular Biology, 2007, vol. 8, pp. 25.

Lapointe J., et al., "Gene Expression Profiling Identifies Clinically Relevant Subtypes of Prostate Cancer," Proceedings of the National Academy of Sciences, 2004, vol. 101 (3), pp. 811-816.

Latil A., et al., "Gene Expression Profiling in Clinically Localized Prostate Cancer: A Four-gene Expression Model Predicts Clinical Behavior," Clinical Cancer Research, 2003, vol. 9 (15), pp. 5477-5485,downloaded from clincancer.aacrjournals.org on Feb. 23, 2011.

Latulippe., et al., "Comprehensive Gene Expression Analysis of Prostate Cancer Reveals Distinct Transcriptional Programs Associated With Metastatic Disease," Cancer Res, 2002, vol. 62, pp. 4499-4506, downloaded from c:incacerres a3CriOUri:Z3j3 org on Feb. 24, 2011.

Lipponen., et al., "High Strome! Hyaluronan Level is Associated With Poor Differentiation and Metastasis in Prostate Cancer," Eur J. Cancer, 2001, vol. 37, pp. 849-856.

Maki., et al., "Screening of Genetic and Expression Alterations of SRC1 Gene in Prostate Cancer," Prostate, 2006, vol. 66, pp. 1391-1398.

Merz., et al., "Differential Expression of Transforming Growth Factor-Beta 1 and Beta 3 as Well as C-Fos mRNA in Normal Human Prostate, Benign Prostatic Hyperplasia and Prostatic Cancer," World J. Urol., 1994, vol. 12, pp. 96-98.

Molinie., et al., "Diagnostic Utility of a p63/a-methyl-CoA-Racemase (p504s) Cocktail in Atypical Foci in the Prostate," Modern Pathology, 2004, vol. 17, pp. 1180-1190.

Mukherjee., et al., "Raf-1 Expression May Influence Progression to Androgen Insensitive Prostate Cancer," Prostate, 2005, vol. 64, pp. 101-107.

Noordzij., et al., "The Prognostic Value of CD44 Isoforms in Prostate Cancer Patients Treated by Radical Prostatectomy," Clin Cancer Res, 1997, vol. 3, pp. 805-815, downloaded from c::ncaricerres aacqc;iJm:?j3 9 on Feb. 7, 2011.

Ohl F., et al., "Gene Expression Studies in Prostate Cancer Tissue: Which Reference Gene Should be Selected for Normalization?," Journal of Molecular Medicine, 2005, vol. 83 (12), pp. 1014-1024.

Okada., et al., "Keratin Profiles in Normal/Hyperplastic Prostates and Prostate Carcinoma," Virchows Arch A Pathol Anat Histopathol., 1992, vol. 421, pp. 157-161.

Paronetto., et al., "Expression of a Truncated Form of the c-Kit Tyrosine Kinase Receptor and Activation of Src Kinase in Human Prostatic Cancer," American Journal of Pathology, 2004, vol. 164 (4), pp. 1243-1251.

Partin et al., "Use of Human Glandular Kallikrein 2 for the Detection of Prostate Cancer Preliminary Analysis," Adult Urology, 1999, vol. 54(5), pp. 839-845.

Perner S., et al., "TMPRSS2-ETS Gene Fusion in Prostate Cancer," Urologe A, 2007, vol. 46 (7), pp. 754-760.

Perttu M.C., et al., "Altered Levels of Smad2 and Smad4 are Associated with Human Prostate Carcinogenesis," Prostate Cancer Prostatic Diseases, 2006, vol. 9 (2), pp. 185-189.

Ramaswamy., et al., "A Molecular Signature of Metastasis in Primary Solid Tumors," Nature Genetics, 2003, vol. 33, pp. 49-54.

Rauhala., et al., "Clusterin is Epigenetically Regulated in Prostate Cancer," Int. J. Cancer, 2008, vol. 123, pp. 1601-1609.

Schlomm., et al., "Molecular Cancer Phenotype in Normal Prostate Tissue," Eur Urol., 2009, vol. 4, pp. 885-890.

Shariat., et al., "Survivin Expression is Associated With Features of Biologically Aggressive Prostate Carcinoma," Cancer, 2004, vol. 100 (4), pp. 751-757.

Sheehan G.M., et al., "Smad4 Protein Expression Correlates with Grade, Stage and DNA Ploidy in Prostatic Adenocarcinomas," Human Pathology, 2005, vol. 36 (11), pp. 1204-1209.

Singh D., et al., "Gene Expression Correlates of Clinical Prostate Cancer Behavior," Cancer Cell, 2002, vol. 1 (2), pp. 203-209.

Sorlie T., et al., "Gene Expression Patterns of Breast Carcinomas Distinguish Tumor Subclasses with Clinical Implications," Proceedings of the National Academy of Sciences, 2001, vol. 98 (19), pp. 10869-10874.

Stattin., et al., "High Levels of Circulating Insulin-Like Growth Factor-I Increase Prostate Cancer Risk: A Prospective Study in a Population-Based Nonscreened Cohort," Journal of Clinical Oncology, 2004, vol. 22 (15), pp. 3104-3112.

Stephenson A.J., et al., "Integration of Gene Expression Profiling and Clinical Variables to Predict Prostate Carcinoma Recurrence after Radical Prostatectomy," Molecular Prediction of Prostate Ca Recurrence, 2005, vol. 104 (2), pp. 290-298.

Tang S.C., et al., "Expression of Glutathione S-transferase M2 in Stage I/II Non-small Cell Lung Cancer and Alleviation of DNA Damage Exposure to Benzo[a]pyrene," Toxicology Letters, 2010, vol. 192 (3), pp. 316-323.

Taylor., et al., "Integrative Genomic Profiling of Human Prostate Cancer," Cancer Cell, 2010, vol. 18, pp. 1-12.

Thalmann., et al., "Osteopontin: Possible Role in Prostate Cancer Progression," Clin Cancer Res, 1999, vol. 5, pp. 2271-2277, downloaded from d:no:arx:erret,..r3acOurnais org on Feb. 7, 2011.

Thomas R., et al., "Differential Expression of Osteonectin/SPARC During Human Prostate Cancer Progression," Clinical Cancer Research, 2000, vol. 6 (3), pp. 1140-1149, downloaded from clincancer.aacrjournals.org on Feb. 7, 2011.

Van Leenders., et al., "Expression of Basal Cell Keratins in Human Prostate Cancer Metastases and Cell Lines," J. Pathol., 2001, vol. 195, pp. 563-570.

Van Leenders., et al., "Intermediate Cells in Human Prostate Epithelium Are Enriched in Proliferative Inflammatory Atrophy," American Journal of Pathology, 2003, vol. 162 ( 5), pp. 1529-1537.

Vis., et al., "Prognostic Value of Cell Cycle Proteins p27(kiplS) and MIB-1, and the Cell Adhesion Protein CD44s in Surgically Treated Patients With Prostate Cancer," J Urol., 2000, vol. 164, pp. 2156-2161.

Written Opinion dated Nov. 17, 2014, for Singapore Patent Application No. 201300086-4.

(56) References Cited

OTHER PUBLICATIONS

Xu., et al., "Expressions of MAD2 and p55CDC in Prostate Cancer and Their Correlations With the Prostate Cancer Grading," Journal of Peking University (Health Sciences), 2003, vol. 35 (6), pp. 586-590.
Yan., et al., "Steroid Receptor Coactivator-3/AIB1 Promotes Cell Migration and Invasiveness Through Focal Adhesion Turnover and Matrix Metalloproteinase Expression," Cancer Res, 2008, vol. 68, pp. 5460-5468, downloaded from c;:ricanc;:m3.aacijouma::.org on Feb. 15, 2011.
Yang., et al., "Differential Expression of Cytokeratin mRNA and Protein in Normal Prostate, Prostatic Intraepithelial Neoplasia, and Invasive Carcinoma," American Journal of Pathology, 1997, vol. 150 (2), pp. 693-704.
Yang., et al., "Meta-Analysis of Several Gene Lists for Distinct Types of Cancer: A Simple Way to Reveal Common Prognostic Markers," BMC Bioinformatics, 2007, vol. 8, pp. 1-17.
Zeng., et al., "Apoptosis Incidence and Protein Expression of p53, TGF-Beta Receptor II, p27Kip1, and Smad4 in Benign, Premalignant, and Malignant Human Prostate," Hum Pathol., 2004, vol. 35, pp. 290-297.
Zhou., et al., "SRC-3 Is Required for Prostate Cancer Cell Proliferation and Survival," Cancer Res, 2005, vol. 65, pp. 7976-7983, downloaded from c,i,...aancerres aacnourriais.oi-g on Feb. 15, 2011.
Li et al., Prostatic Intraepithelial Neoplasia and Adenocarcinoma in Mice Expressing a Probasin-Neu Oncogenic Transgene, Carcinogenesis, vol. 27, No. 5, 2006, pp. 1054-1067.
Murphy et al., "Patented Prostate Cancer Biomarkers", Nature Reviews Urology, vol. 9, No. 8, 2012, pp. 464-472.
Partial European Search Report dated May 11, 2017, for European Patent Application No. 16191856.0.
Cuzick et al,. "Prognostc value of an RNA expression signature derived from cell cycle proliferation genes in patient with prostate cancer: a retrospective study", Lancet Oncology, vol. 12, 2011. pp. 245-255.
Kidokoro et al., "CDC20, a potential cancer therapeutic target, is negatively regulated by p53", Oncogene, vol. 27. 2008, pp. 1562-1571.
Haller et al., "Equivalence Test in Quantitative Reverse Transcription Polymerase Chain Reaction: Confirmation of Reference Genes Suitable for Normalization", Analytical Biochemistry, vol. 335, No. 1, 2004, pp. 1-9.
Yang et al., "A Molecular Classification of Papillary Renal Cell Carcinoma", Cancer Research, vol. 65, 2005, pp. 5628-5637.
Yao et al., "A Three-Gene Expression Signature Model to Predict Clinical Outcome of Clear Cell Renal Carcinoma", Int. J. Cancer, vol. 123, No. 5, 2008, pp. 1126-1132.
Partial European Search Report dated May 8, 2017, for European Patent Application No. 17153152.8.
Extended Search Report dated Aug. 16, 2017, for European Patent Application No. 16191856.0.
Ohl et al., Gene expression studies in prostate cancer tissue: which reference gene should be selected for normalization?, J. Mol. Med. (Berl) 83(12):1014-24, Abstract, 2005.

\* cited by examiner

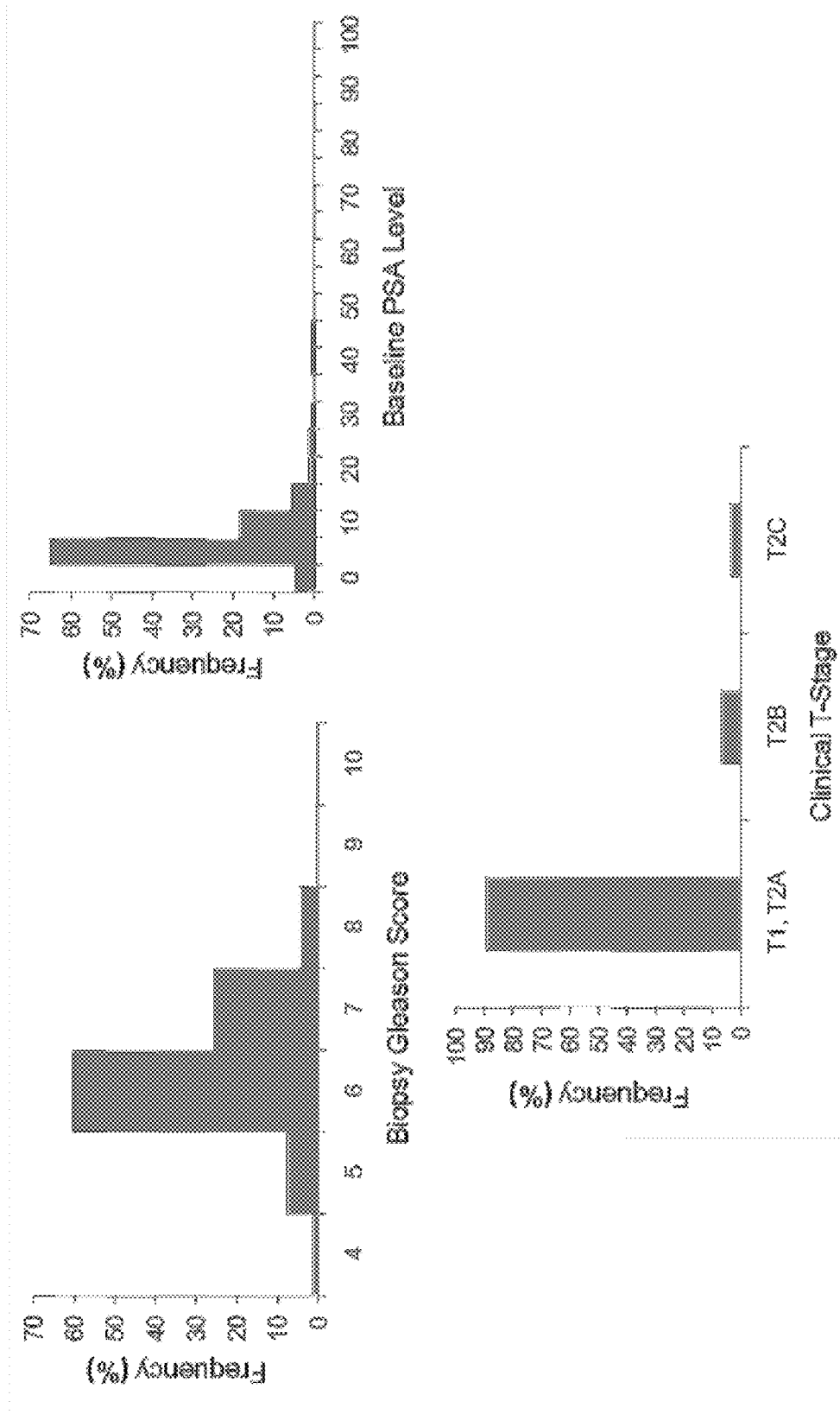

METHOD FOR USING GENE EXPRESSION TO DETERMINE PROGNOSIS OF PROSTATE CANCER

This application is a continuation of U.S. patent application Ser. No. 13/190,391, filed Jul. 25, 2011, and claims the benefit of priority to U.S. Provisional Application Nos. 61/368,217, filed Jul. 27, 2010; 61/414,310, filed Nov. 16, 2010; and 61/485,536, filed May 12, 2011, all of which are hereby incorporated by reference in their entirety.

TECHNICAL FIELD

The present disclosure relates to molecular diagnostic assays that provide information concerning methods to use gene expression profiles to determine prognostic information for cancer patients. Specifically, the present disclosure provides genes and microRNAs, the expression levels of which may be used to determine the likelihood that a prostate cancer patient will experience a local or distant cancer recurrence.

INTRODUCTION

Prostate cancer is the most common solid malignancy in men and the second most common cause of cancer-related death in men in North America and the European Union (EU). In 2008, over 180,000 patients will be diagnosed with prostate cancer in the United States alone and nearly 30,000 will die of this disease. Age is the single most important risk factor for the development of prostate cancer, and applies across all racial groups that have been studied. With the aging of the U.S. population, it is projected that the annual incidence of prostate cancer will double by 2025 to nearly 400,000 cases per year.

Since the introduction of prostate-specific antigen (PSA) screening in the 1990's, the proportion of patients presenting with clinically evident disease has fallen dramatically such that patients categorized as "low risk" now constitute half of new diagnoses today. PSA is used as a tumor marker to determine the presence of prostate cancer as high PSA levels are associated with prostate cancer. Despite a growing proportion of localized prostate cancer patients presenting with low-risk features such as low stage (T1) disease, greater than 90% of patients in the US still undergo definitive therapy, including prostatectomy or radiation. Only about 15% of these patients would develop metastatic disease and die from their prostate cancer, even in the absence of definitive therapy. A. Bill-Axelson, et al., J Nat'l Cancer Inst. 100(16):1144-1154 (2008). Therefore, the majority of prostate cancer patients are being over-treated.

Estimates of recurrence risk and treatment decisions in prostate cancer are currently based primarily on PSA levels and/or tumor stage. Although tumor stage has been demonstrated to have significant association with outcome sufficient to be included in pathology reports, the College of American Pathologists Consensus Statement noted that variations in approach to the acquisition, interpretation, reporting, and analysis of this information exist. C. Compton, et al., Arch Pathol Lab Med 124:979-992 (2000). As a consequence, existing pathologic staging methods have been criticized as lacking reproducibility and therefore may provide imprecise estimates of individual patient risk.

SUMMARY

This application discloses molecular assays that involve measurement of expression level(s) of one or more genes, gene subsets, microRNAs, or one or more microRNAs in combination with one or more genes or gene subsets, from a biological sample obtained from a prostate cancer patient, and analysis of the measured expression levels to provide information concerning the likelihood of cancer recurrence. For example, the likelihood of cancer recurrence could be described in terms of a score based on clinical or biochemical recurrence-free interval.

In addition, this application discloses molecular assays that involve measurement of expression level(s) of one or more genes, gene subsets, microRNAs, or one or more microRNAs in combination with one or more genes or gene subsets, from a biological sample obtained to identify a risk classification for a prostate cancer patient. For example, patients may be stratified using expression level(s) of one or more genes or microRNAs associated, positively or negatively, with cancer recurrence or death from cancer, or with a prognostic factor. In an exemplary embodiment, the prognostic factor is Gleason pattern.

The biological sample may be obtained from standard methods, including surgery, biopsy, or bodily fluids. It may comprise tumor tissue or cancer cells, and, in some cases, histologically normal tissue, e.g., histologically normal tissue adjacent the tumor tissue. In exemplary embodiments, the biological sample is positive or negative for a TMPRSS2 fusion.

In exemplary embodiments, expression level(s) of one or more genes and/or microRNAs that are associated, positively or negatively, with a particular clinical outcome in prostate cancer are used to determine prognosis and appropriate therapy. The genes disclosed herein may be used alone or arranged in functional gene subsets, such as cell adhesion/migration, immediate-early stress response, and extracellular matrix-associated. Each gene subset comprises the genes disclosed herein, as well as genes that are co-expressed with one or more of the disclosed genes. The calculation may be performed on a computer, programmed to execute the gene expression analysis. The microRNAs disclosed herein may also be used alone or in combination with any one or more of the microRNAs and/or genes disclosed.

In exemplary embodiments, the molecular assay may involve expression levels for at least two genes. The genes, or gene subsets, may be weighted according to strength of association with prognosis or tumor microenvironment. In another exemplary embodiment, the molecular assay may involve expression levels of at least one gene and at least one microRNA. The gene-microRNA combination may be selected based on the likelihood that the gene-microRNA combination functionally interact.

BRIEF DESCRIPTION OF THE DRAWING

FIG. 1 shows the distribution of clinical and pathology assessments of biopsy Gleason score, baseline PSA level, and clinical T-stage.

DEFINITIONS

Unless defined otherwise, technical and scientific terms used herein have the same meaning as commonly understood by one of ordinary skill in the art to which this invention belongs. Singleton et al., Dictionary of Microbiology and Molecular Biology 2nd ed., J. Wiley & Sons (New York, N.Y. 1994), and March, Advanced Organic Chemistry Reactions, Mechanisms and Structure 4th ed., John Wiley &

Sons (New York, N.Y. 1992), provide one skilled in the art with a general guide to many of the terms used in the present application.

One skilled in the art will recognize many methods and materials similar or equivalent to those described herein, which could be used in the practice of the present invention. Indeed, the present invention is in no way limited to the methods and materials described herein. For purposes of the invention, the following terms are defined below.

The terms "tumor" and "lesion" as used herein, refer to all neoplastic cell growth and proliferation, whether malignant or benign, and all pre-cancerous and cancerous cells and tissues. Those skilled in the art will realize that a tumor tissue sample may comprise multiple biological elements, such as one or more cancer cells, partial or fragmented cells, tumors in various stages, surrounding histologically normal-appearing tissue, and/or macro or micro-dissected tissue.

The terms "cancer" and "cancerous" refer to or describe the physiological condition in mammals that is typically characterized by unregulated cell growth. Examples of cancer in the present disclosure include cancer of the urogenital tract, such as prostate cancer.

The "pathology" of cancer includes all phenomena that compromise the well-being of the patient. This includes, without limitation, abnormal or uncontrollable cell growth, metastasis, interference with the normal functioning of neighboring cells, release of cytokines or other secretory products at abnormal levels, suppression or aggravation of inflammatory or immunological response, neoplasia, premalignancy, malignancy, invasion of surrounding or distant tissues or organs, such as lymph nodes, etc.

As used herein, the term "prostate cancer" is used interchangeably and in the broadest sense refers to all stages and all forms of cancer arising from the tissue of the prostate gland.

According to the tumor, node, metastasis (TNM) staging system of the American Joint Committee on Cancer (AJCC), AJCC Cancer Staging Manual (7th Ed., 2010), the various stages of prostate cancer are defined as follows: Tumor: T1: clinically inapparent tumor not palpable or visible by imaging, T1a: tumor incidental histological finding in 5% or less of tissue resected, T1b: tumor incidental histological finding in more than 5% of tissue resected, T1c: tumor identified by needle biopsy; T2: tumor confined within prostate, T2a: tumor involves one half of one lobe or less, T2b: tumor involves more than half of one lobe, but not both lobes, T2c: tumor involves both lobes; T3: tumor extends through the prostatic capsule, T3a: extracapsular extension (unilateral or bilateral), T3b: tumor invades seminal vesicle(s); T4: tumor is fixed or invades adjacent structures other than seminal vesicles (bladder neck, external sphincter, rectum, levator muscles, or pelvic wall). Node: N0: no regional lymph node metastasis; N1: metastasis in regional lymph nodes. Metastasis: M0: no distant metastasis; M1: distant metastasis present.

The Gleason Grading system is used to help evaluate the prognosis of men with prostate cancer. Together with other parameters, it is incorporated into a strategy of prostate cancer staging, which predicts prognosis and helps guide therapy. A Gleason "score" or "grade" is given to prostate cancer based upon its microscopic appearance. Tumors with a low Gleason score typically grow slowly enough that they may not pose a significant threat to the patients in their lifetimes. These patients are monitored ("watchful waiting" or "active surveillance") over time. Cancers with a higher Gleason score are more aggressive and have a worse prognosis, and these patients are generally treated with surgery (e.g., radical prostectomy) and, in some cases, therapy (e.g., radiation, hormone, ultrasound, chemotherapy). Gleason scores (or sums) comprise grades of the two most common tumor patterns. These patterns are referred to as Gleason patterns 1-5, with pattern 1 being the most well-differentiated. Most have a mixture of patterns. To obtain a Gleason score or grade, the dominant pattern is added to the second most prevalent pattern to obtain a number between 2 and 10. The Gleason Grades include: G1: well differentiated (slight anaplasia) (Gleason 2-4); G2: moderately differentiated (moderate anaplasia) (Gleason 5-6); G3-4: poorly differentiated/undifferentiated (marked anaplasia) (Gleason 7-10).

Stage groupings: Stage I: T1a N0 M0 G1; Stage II: (T1a N0 M0 G2-4) or (T1b, c, T1, T2, N0 M0 Any G); Stage III: T3 N0 M0 Any G; Stage IV: (T4 N0 M0 Any G) or (Any T N1 M0 Any G) or (Any T Any N M1 Any G).

As used herein, the term "tumor tissue" refers to a biological sample containing one or more cancer cells, or a fraction of one or more cancer cells. Those skilled in the art will recognize that such biological sample may additionally comprise other biological components, such as histologically appearing normal cells (e.g., adjacent the tumor), depending upon the method used to obtain the tumor tissue, such as surgical resection, biopsy, or bodily fluids.

As used herein, the term "AUA risk group" refers to the 2007 updated American Urological Association (AUA) guidelines for management of clinically localized prostate cancer, which clinicians use to determine whether a patient is at low, intermediate, or high risk of biochemical (PSA) relapse after local therapy.

As used herein, the term "adjacent tissue (AT)" refers to histologically "normal" cells that are adjacent a tumor. For example, the AT expression profile may be associated with disease recurrence and survival.

As used herein "non-tumor prostate tissue" refers to histologically normal-appearing tissue adjacent a prostate tumor.

Prognostic factors are those variables related to the natural history of cancer, which influence the recurrence rates and outcome of patients once they have developed cancer. Clinical parameters that have been associated with a worse prognosis include, for example, increased tumor stage, PSA level at presentation, and Gleason grade or pattern. Prognostic factors are frequently used to categorize patients into subgroups with different baseline relapse risks.

The term "prognosis" is used herein to refer to the likelihood that a cancer patient will have a cancer-attributable death or progression, including recurrence, metastatic spread, and drug resistance, of a neoplastic disease, such as prostate cancer. For example, a "good prognosis" would include long term survival without recurrence and a "bad prognosis" would include cancer recurrence.

As used herein, the term "expression level" as applied to a gene refers to the normalized level of a gene product, e.g. the normalized value determined for the RNA expression level of a gene or for the polypeptide expression level of a gene.

The term "gene product" or "expression product" are used herein to refer to the RNA (ribonucleic acid) transcription products (transcripts) of the gene, including mRNA, and the polypeptide translation products of such RNA transcripts. A gene product can be, for example, an unspliced RNA, an mRNA, a splice variant mRNA, a microRNA, a fragmented RNA, a polypeptide, a post-translationally modified polypeptide, a splice variant polypeptide, etc.

The term "RNA transcript" as used herein refers to the RNA transcription products of a gene, including, for example, mRNA, an unspliced RNA, a splice variant mRNA, a microRNA, and a fragmented RNA.

The term "microRNA" is used herein to refer to a small, non-coding, single-stranded RNA of ~18-25 nucleotides that may regulate gene expression. For example, when associated with the RNA-induced silencing complex (RISC), the complex binds to specific mRNA targets and causes translation repression or cleavage of these mRNA sequences.

Unless indicated otherwise, each gene name used herein corresponds to the Official Symbol assigned to the gene and provided by Entrez Gene (URL: www.ncbi.nlm.nih.gov/sites/entrez) as of the filing date of this application.

The terms "correlated" and "associated" are used interchangeably herein to refer to the association between two measurements (or measured entities). The disclosure provides genes, gene subsets, microRNAs, or microRNAs in combination with genes or gene subsets, the expression levels of which are associated with tumor stage. For example, the increased expression level of a gene or microRNA may be positively correlated (positively associated) with a good or positive prognosis. Such a positive correlation may be demonstrated statistically in various ways, e.g. by a cancer recurrence hazard ratio less than one. In another example, the increased expression level of a gene or microRNA may be negatively correlated (negatively associated) with a good or positive prognosis. In that case, for example, the patient may experience a cancer recurrence.

The terms "good prognosis" or "positive prognosis" as used herein refer to a beneficial clinical outcome, such as long-term survival without recurrence. The terms "bad prognosis" or "negative prognosis" as used herein refer to a negative clinical outcome, such as cancer recurrence.

The term "risk classification" means a grouping of subjects by the level of risk (or likelihood) that the subject will experience a particular clinical outcome. A subject may be classified into a risk group or classified at a level of risk based on the methods of the present disclosure, e.g. high, medium, or low risk. A "risk group" is a group of subjects or individuals with a similar level of risk for a particular clinical outcome.

The term "long-term" survival is used herein to refer to survival for a particular time period, e.g., for at least 5 years, or for at least 10 years.

The term "recurrence" is used herein to refer to local or distant recurrence (i.e., metastasis) of cancer. For example, prostate cancer can recur locally in the tissue next to the prostate or in the seminal vesicles. The cancer may also affect the surrounding lymph nodes in the pelvis or lymph nodes outside this area. Prostate cancer can also spread to tissues next to the prostate, such as pelvic muscles, bones, or other organs. Recurrence can be determined by clinical recurrence detected by, for example, imaging study or biopsy, or biochemical recurrence detected by, for example, sustained follow-up prostate-specific antigen (PSA) levels ≥0.4 ng/mL or the initiation of salvage therapy as a result of a rising PSA level.

The term "clinical recurrence-free interval (cRFI)" is used herein as time (in months) from surgery to first clinical recurrence or death due to clinical recurrence of prostate cancer. Losses due to incomplete follow-up, other primary cancers or death prior to clinical recurrence are considered censoring events; when these occur, the only information known is that up through the censoring time, clinical recurrence has not occurred in this subject. Biochemical recurrences are ignored for the purposes of calculating cRFI.

The term "biochemical recurrence-free interval (bRFI)" is used herein to mean the time (in months) from surgery to first biochemical recurrence of prostate cancer. Clinical recurrences, losses due to incomplete follow-up, other primary cancers, or death prior to biochemical recurrence are considered censoring events.

The term "Overall Survival (OS)" is used herein to refer to the time (in months) from surgery to death from any cause. Losses due to incomplete follow-up are considered cause. Losses due to incomplete follow-up are considered censoring events. Biochemical recurrence and clinical recurrence are ignored for the purposes of calculating OS.

The term "Prostate Cancer-Specific Survival (PCSS)" is used herein to describe the time (in years) from surgery to death from prostate cancer. Losses due to incomplete follow-up or deaths from other causes are considered censoring events. Clinical recurrence and biochemical recurrence are ignored for the purposes of calculating PCSS.

The term "upgrading" or "upstaging" as used herein refers to a change in Gleason grade from 3+3 at the time of biopsy to 3+4 or greater at the time of radical prostatectomy (RP), or Gleason grade 3+4 at the time of biopsy to 4+3 or greater at the time of RP, or seminal vessical involvement (SVI), or extracapsular involvement (ECE) at the time of RP.

In practice, the calculation of the measures listed above may vary from study to study depending on the definition of events to be considered censored.

The term "microarray" refers to an ordered arrangement of hybridizable array elements, e.g. oligonucleotide or polynucleotide probes, on a substrate.

The term "polynucleotide" generally refers to any polyribonucleotide or polydeoxribonucleotide, which may be unmodified RNA or DNA or modified RNA or DNA. Thus, for instance, polynucleotides as defined herein include, without limitation, single- and double-stranded DNA, DNA including single- and double-stranded regions, single- and double-stranded RNA, and RNA including single- and double-stranded regions, hybrid molecules comprising DNA and RNA that may be single-stranded or, more typically, double-stranded or include single- and double-stranded regions. In addition, the term "polynucleotide" as used herein refers to triple-stranded regions comprising RNA or DNA or both RNA and DNA. The strands in such regions may be from the same molecule or from different molecules. The regions may include all of one or more of the molecules, but more typically involve only a region of some of the molecules. One of the molecules of a triple-helical region often is an oligonucleotide. The term "polynucleotide" specifically includes cDNAs. The term includes DNAs (including cDNAs) and RNAs that contain one or more modified bases. Thus, DNAs or RNAs with backbones modified for stability or for other reasons, are "polynucleotides" as that term is intended herein. Moreover, DNAs or RNAs comprising unusual bases, such as inosine, or modified bases, such as tritiated bases, are included within the term "polynucleotides" as defined herein. In general, the term "polynucleotide" embraces all chemically, enzymatically and/or metabolically modified forms of unmodified polynucleotides, as well as the chemical forms of DNA and RNA characteristic of viruses and cells, including simple and complex cells.

The term "oligonucleotide" refers to a relatively short polynucleotide, including, without limitation, single-stranded deoxyribonucleotides, single- or double-stranded ribonucleotides, RNArDNA hybrids and double-stranded DNAs. Oligonucleotides, such as single-stranded DNA probe oligonucleotides, are often synthesized by chemical methods, for example using automated oligonucleotide synthesizers that are commercially available. However, oligonucleotides can be made by a variety of other methods, including in vitro recombinant DNA-mediated techniques and by expression of DNAs in cells and organisms.

The term "Ct" as used herein refers to threshold cycle, the cycle number in quantitative polymerase chain reaction (qPCR) at which the fluorescence generated within a reaction well exceeds the defined threshold, i.e. the point during the reaction at which a sufficient number of amplicons have accumulated to meet the defined threshold.

The term "Cp" as used herein refers to "crossing point." The Cp value is calculated by determining the second derivatives of entire qPCR amplification curves and their maximum value. The Cp value represents the cycle at which the increase of fluorescence is highest and where the logarithmic phase of a PCR begins.

The terms "threshold" or "thresholding" refer to a procedure used to account for non-linear relationships between gene expression measurements and clinical response as well as to further reduce variation in reported patient scores. When thresholding is applied, all measurements below or above a threshold are set to that threshold value. Non-linear relationship between gene expression and outcome could be examined using smoothers or cubic splines to model gene expression in Cox PH regression on recurrence free interval or logistic regression on recurrence status. D. Cox, Journal of the Royal Statistical Society, Series B 34:187-220 (1972). Variation in reported patient scores could be examined as a function of variability in gene expression at the limit of quantitation and/or detection for a particular gene.

As used herein, the term "amplicon," refers to pieces of DNA that have been synthesized using amplification techniques, such as polymerase chain reactions (PCR) and ligase chain reactions.

"Stringency" of hybridization reactions is readily determinable by one of ordinary skill in the art, and generally is an empirical calculation dependent upon probe length, washing temperature, and salt concentration. In general, longer probes require higher temperatures for proper annealing, while shorter probes need lower temperatures. Hybridization generally depends on the ability of denatured DNA to re-anneal when complementary strands are present in an environment below their melting temperature. The higher the degree of desired homology between the probe and hybridizable sequence, the higher the relative temperature which can be used. As a result, it follows that higher relative temperatures would tend to make the reaction conditions more stringent, while lower temperatures less so. For additional details and explanation of stringency of hybridization reactions, see Ausubel et al., Current Protocols in Molecular Biology (Wiley Interscience Publishers, 1995).

"Stringent conditions" or "high stringency conditions", as defined herein, typically: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/ 0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 µg/ml), 0.1% SDS, and 10% dextran sulfate at 42° C., with washes at 42° C. in 0.2×SSC (sodium chloride/sodium citrate) and 50% formamide, followed by a high-stringency wash consisting of 0.1×SSC containing EDTA at 55° C.

"Moderately stringent conditions" may be identified as described by Sambrook et al., Molecular Cloning: A Laboratory Manual, New York: Cold Spring Harbor Press, 1989, and include the use of washing solution and hybridization conditions (e.g., temperature, ionic strength and % SDS) less stringent that those described above. An example of moderately stringent conditions is overnight incubation at 37° C. in a solution comprising: 20% formamide, 5×SSC (150 mM NaCl, 15 mM trisodium citrate), 50 mM sodium phosphate (pH 7.6), 5×Denhardt's solution, 10% dextran sulfate, and 20 mg/ml denatured sheared salmon sperm DNA, followed by washing the filters in 1×SSC at about 37-500 C. The skilled artisan will recognize how to adjust the temperature, ionic strength, etc. as necessary to accommodate factors such as probe length and the like.

The terms "splicing" and "RNA splicing" are used interchangeably and refer to RNA processing that removes introns and joins exons to produce mature mRNA with continuous coding sequence that moves into the cytoplasm of an eukaryotic cell.

The terms "co-express" and "co-expressed", as used herein, refer to a statistical correlation between the amounts of different transcript sequences across a population of different patients. Pairwise co-expression may be calculated by various methods known in the art, e.g., by calculating Pearson correlation coefficients or Spearman correlation coefficients. Co-expressed gene cliques may also be identified using graph theory. An analysis of co-expression may be calculated using normalized expression data. A gene is said to be co-expressed with a particular disclosed gene when the expression level of the gene exhibits a Pearson correlation coefficient greater than or equal to 0.6.

A "computer-based system" refers to a system of hardware, software, and data storage medium used to analyze information. The minimum hardware of a patient computer-based system comprises a central processing unit (CPU), and hardware for data input, data output (e.g., display), and data storage. An ordinarily skilled artisan can readily appreciate that any currently available computer-based systems and/or components thereof are suitable for use in connection with the methods of the present disclosure. The data storage medium may comprise any manufacture comprising a recording of the present information as described above, or a memory access device that can access such a manufacture.

To "record" data, programming or other information on a computer readable medium refers to a process for storing information, using any such methods as known in the art. Any convenient data storage structure may be chosen, based on the means used to access the stored information. A variety of data processor programs and formats can be used for storage, e.g. word processing text file, database format, etc.

A "processor" or "computing means" references any hardware and/or software combination that will perform the functions required of it. For example, a suitable processor may be a programmable digital microprocessor such as available in the form of an electronic controller, mainframe, server or personal computer (desktop or portable). Where the processor is programmable, suitable programming can be communicated from a remote location to the processor, or previously saved in a computer program product (such as a portable or fixed computer readable storage medium, whether magnetic, optical or solid state device based). For example, a magnetic medium or optical disk may carry the programming, and can be read by a suitable reader communicating with each processor at its corresponding station.

As used herein, the terms "active surveillance" and "watchful waiting" mean closely monitoring a patient's condition without giving any treatment until symptoms appear or change. For example, in prostate cancer, watchful waiting is usually used in older men with other medical problems and early-stage disease.

As used herein, the term "surgery" applies to surgical methods undertaken for removal of cancerous tissue, including pelvic lymphadenectomy, radical prostatectomy, transurethral resection of the prostate (TURP), excision, dissection, and tumor biopsy/removal. The tumor tissue or sections used for gene expression analysis may have been obtained from any of these methods.

As used herein, the term "therapy" includes radiation, hormonal therapy, cryosurgery, chemotherapy, biologic therapy, and high-intensity focused ultrasound.

As used herein, the term "TMPRSS fusion" and "TMPRSS2 fusion" are used interchangeably and refer to a fusion of the androgen-driven TMPRSS2 gene with the ERG oncogene, which has been demonstrated to have a significant association with prostate cancer. S. Perner, et al., Urologe A. 46(7):754-760 (2007); S. A. Narod, et al., Br J Cancer 99(6):847-851 (2008). As used herein, positive TMPRSS fusion status indicates that the TMPRSS fusion is present in a tissue sample, whereas negative TMPRSS fusion status indicates that the TMPRSS fusion is not present in a tissue sample. Experts skilled in the art will recognize that there are numerous ways to determine TMPRSS fusion status, such as real-time, quantitative PCR or high-throughput sequencing. See, e.g., K. Mertz, et al., Neoplasis 9(3): 200-206 (2007); C. Maher, Nature 458(7234):97-101 (2009).

Gene Expression Methods Using Genes, Gene Subsets, and MicroRNAs

The present disclosure provides molecular assays that involve measurement of expression level(s) of one or more genes, gene subsets, microRNAs, or one or more microRNAs in combination with one or more genes or gene subsets, from a biological sample obtained from a prostate cancer patient, and analysis of the measured expression levels to provide information concerning the likelihood of cancer recurrence.

The present disclosure further provides methods to classify a prostate tumor based on expression level(s) of one or more genes and/or microRNAs. The disclosure further provides genes and/or microRNAs that are associated, positively or negatively, with a particular prognostic outcome. In exemplary embodiments, the clinical outcomes include cRFI and bRFI. In another embodiment, patients may be classified in risk groups based on the expression level(s) of one or more genes and/or microRNAs that are associated, positively or negatively, with a prognostic factor. In an exemplary embodiment, that prognostic factor is Gleason pattern.

Various technological approaches for determination of expression levels of the disclosed genes and microRNAs are set forth in this specification, including, without limitation, RT-PCR, microarrays, high-throughput sequencing, serial analysis of gene expression (SAGE) and Digital Gene Expression (DGE), which will be discussed in detail below. In particular aspects, the expression level of each gene or microRNA may be determined in relation to various features of the expression products of the gene including exons, introns, protein epitopes and protein activity.

The expression level(s) of one or more genes and/or microRNAs may be measured in tumor tissue. For example, the tumor tissue may obtained upon surgical removal or resection of the tumor, or by tumor biopsy. The tumor tissue may be or include histologically "normal" tissue, for example histologically "normal" tissue adjacent to a tumor. The expression level of genes and/or microRNAs may also be measured in tumor cells recovered from sites distant from the tumor, for example circulating tumor cells, body fluid (e.g., urine, blood, blood fraction, etc.).

The expression product that is assayed can be, for example, RNA or a polypeptide. The expression product may be fragmented. For example, the assay may use primers that are complementary to target sequences of an expression product and could thus measure full transcripts as well as those fragmented expression products containing the target sequence. Further information is provided in Table A (inserted in specification prior to claims).

The RNA expression product may be assayed directly or by detection of a cDNA product resulting from a PCR-based amplification method, e.g., quantitative reverse transcription polymerase chain reaction (qRT-PCR). (See e.g., U.S. Pat. No. 7,587,279). Polypeptide expression product may be assayed using immunohistochemistry (IHC). Further, both RNA and polypeptide expression products may also be is assayed using microarrays.

Clinical Utility

Prostate cancer is currently diagnosed using a digital rectal exam (DRE) and Prostate-specific antigen (PSA) test. If PSA results are high, patients will generally undergo a prostate tissue biopsy. The pathologist will review the biopsy samples to check for cancer cells and determine a Gleason score. Based on the Gleason score, PSA, clinical stage, and other factors, the physician must make a decision whether to monitor the patient, or treat the patient with surgery and therapy.

At present, clinical decision-making in early stage prostate cancer is governed by certain histopathologic and clinical factors. These include: (1) tumor factors, such as clinical stage (e.g. T1, T2), PSA level at presentation, and Gleason grade, that are very strong prognostic factors in determining outcome; and (2) host factors, such as age at diagnosis and co-morbidity. Because of these factors, the most clinically useful means of stratifying patients with localized disease according to prognosis has been through multifactorial staging, using the clinical stage, the serum PSA level, and tumor grade (Gleason grade) together. In the 2007 updated American Urological Association (AUA) guidelines for management of clinically localized prostate cancer, these parameters have been grouped to determine whether a patient is at low, intermediate, or high risk of biochemical (PSA) relapse after local therapy. I. Thompson, et al., Guideline for the management of clinically localized prostate cancer, J Urol. 177(6):2106-31 (2007).

Although such classifications have proven to be helpful in distinguishing patients with localized disease who may need adjuvant therapy after surgery/radiation, they have less ability to discriminate between indolent cancers, which do not need to be treated with local therapy, and aggressive tumors, which require local therapy. In fact, these algorithms are of increasingly limited use for deciding between conservative management and definitive therapy because the bulk of prostate cancers diagnosed in the PSA screening era now present with clinical stage T1c and PSA≤10 ng/mL.

Patients with T1 prostate cancer have disease that is not clinically apparent but is discovered either at transurethral resection of the prostate (TURP, T1a, T1b) or at biopsy performed because of an elevated PSA (>4 ng/mL, T1c). Approximately 80% of the cases presenting in 2007 are clinical T1 at diagnosis. In a Scandinavian trial, OS at 10 years was 85% for patients with early stage prostate cancer (T1/T2) and Gleason score ≤7, after radical prostatectomy.

Patients with T2 prostate cancer have disease that is clinically evident and is organ confined; patients with T3 tumors have disease that has penetrated the prostatic capsule and/or has invaded the seminal vesicles. It is known from surgical series that clinical staging underestimates pathological stage, so that about 20% of patients who are clinically T2 will be pT3 after prostatectomy. Most of patients with T2 or T3 prostate cancer are treated with local therapy, either prostatectomy or radiation. The data from the Scandinavian trial suggest that for T2 patients with Gleason grade ≤7, the effect of prostatectomy on survival is at most 5% at 10 years; the majority of patients do not benefit from surgical treatment at the time of diagnosis. For T2 patients with Gleason ≥7 or for T3 patients, the treatment effect of prostatectomy is assumed to be significant but has not been determined in randomized trials. It is known that these patients have a significant risk (10-30%) of recurrence at 10 years after local treatment, however, there are no prospective randomized trials that define the optimal local treatment (radical prostatectomy, radiation) at diagnosis, which patients are likely to benefit from neo-adjuvant/adjuvant androgen deprivation therapy, and whether treatment (androgen deprivation, chemotherapy) at the time of biochemical failure (elevated PSA) has any clinical benefit.

Accurately determining Gleason scores from needle biopsies presents several technical challenges. First, interpreting histology that is "borderline" between Gleason pattern is highly subjective, even for urologic pathologists. Second, incomplete biopsy sampling is yet another reason why the "predicted" Gleason score on biopsy does not always correlate with the actual "observed" Gleason score of the prostate cancer in the gland itself. Hence, the accuracy of Gleason scoring is dependent upon not only the expertise of the pathologist reading the slides, but also on the completeness and adequacy of the prostate biopsy sampling strategy. T. Stamey, Urology 45:2-12 (1995). The gene/microRNA expression assay and associated information provided by the practice of the methods disclosed herein provide a molecular assay method to facilitate optimal treatment decision-making in early stage prostate cancer. An exemplary embodiment provides genes and microRNAs, the expression levels of which are associated (positively or negatively) with prostate cancer recurrence. For example, such a clinical tool would enable physicians to identify T2/T3 patients who are likely to recur following definitive therapy and need adjuvant treatment.

In addition, the methods disclosed herein may allow physicians to classify tumors, at a molecular level, based on expression level(s) of one or more genes and/or microRNAs that are significantly associated with prognostic factors, such as Gleason pattern and TMPRSS fusion status. These methods would not be impacted by the technical difficulties of intra-patient variability, histologically determining Gleason pattern in biopsy samples, or inclusion of histologically normal appearing tissue adjacent to tumor tissue. Multi-analyte gene/microRNA expression tests can be used to measure the expression level of one or more genes and/or microRNAs involved in each of several relevant physiologic processes or component cellular characteristics. The methods disclosed herein may group the genes and/or microRNAs. The grouping of genes and microRNAs may be performed at least in part based on knowledge of the contribution of those genes and/or microRNAs according to physiologic functions or component cellular characteristics, such as in the groups discussed above. Furthermore, one or more microRNAs may be combined with one or moregenes. The gene-microRNA combination may be selected based on the likelihood that the gene-microRNA combination functionally interact. The formation of groups (or gene subsets), in addition, can facilitate the mathematical weighting of the contribution of various expression levels to cancer recurrence. The weighting of a gene/microRNA group representing a physiological process or component cellular characteristic can reflect the contribution of that process or characteristic to the pathology of the cancer and clinical outcome.

Optionally, the methods disclosed may be used to classify patients by risk, for example risk of recurrence. Patients can be partitioned into subgroups (e.g., tertiles or quartiles) and the values chosen will define subgroups of patients with respectively greater or lesser risk.

The utility of a disclosed gene marker in predicting prognosis may not be unique to that marker. An alternative marker having an expression pattern that is parallel to that of a disclosed gene may be substituted for, or used in addition to, that co-expressed gene or microRNA. Due to the co-expression of such genes or microRNAs, substitution of expression level values should have little impact on the overall utility of the test. The closely similar expression patterns of two genes or microRNAs may result from involvement of both genes or microRNAs in the same process and/or being under common regulatory control in prostate tumor cells. The present disclosure thus contemplates the use of such co-expressed genes, gene subsets, or microRNAs as substitutes for, or in addition to, genes of the present disclosure.

Methods of Assaying Expression Levels of a Gene Product

The methods and compositions of the present disclosure will employ, unless otherwise indicated, conventional techniques of molecular biology (including recombinant techniques), microbiology, cell biology, and biochemistry, which are within the skill of the art. Exemplary techniques are explained fully in the literature, such as, "Molecular Cloning: A Laboratory Manual", 2nd edition (Sambrook et al., 1989); "Oligonucleotide Synthesis" (M. J. Gait, ed., 1984); "Animal Cell Culture" (R. I. Freshney, ed., 1987); "Methods in Enzymology" (Academic Press, Inc.); "Handbook of Experimental Immunology", 4th edition (D. M. Weir & C. C. Blackwell, eds., Blackwell Science Inc., 1987); "Gene Transfer Vectors for Mammalian Cells" (J. M. Miller & M. P. Calos, eds., 1987); "Current Protocols in Molecular Biology" (F. M. Ausubel et al., eds., 1987); and "PCR: The Polymerase Chain Reaction", (Mullis et al., eds., 1994).

Methods of gene expression profiling include methods based on hybridization analysis of polynucleotides, methods based on sequencing of polynucleotides, and proteomics-based methods. Exemplary methods known in the art for the quantification of RNA expression in a sample include northern blotting and in situ hybridization (Parker & Barnes, Methods in Molecular Biology 106:247-283 (1999)); RNAse protection assays (Hod, Biotechniques 13:852-854 (1992)); and PCR-based methods, such as reverse transcription PCT (RT-PCR) (Weis et al., Trends in Genetics 8:263-264 (1992)). Antibodies may be employed that can recognize sequence-specific duplexes, including DNA duplexes, RNA duplexes, and DNA-RNA hybrid duplexes or DNA-protein duplexes. Representative methods for sequencing-based gene expression analysis include Serial Analysis of Gene Expression (SAGE), and gene expression analysis by massively parallel signature sequencing (MPSS).

Reverse Transcriptase PCR (RT-PCR)

Typically, mRNA or microRNA is isolated from a test sample. The starting material is typically total RNA isolated from a human tumor, usually from a primary tumor. Optionally, normal tissues from the same patient can be used as an internal control. Such normal tissue can be histologically-appearing normal tissue adjacent a tumor. mRNA or microRNA can be extracted from a tissue sample, e.g., from a sample that is fresh, frozen (e.g. fresh frozen), or paraffin-embedded and fixed (e.g. formalin-fixed).

General methods for mRNA and microRNA extraction are well known in the art and are disclosed in standard textbooks of molecular biology, including Ausubel et al., Current Protocols of Molecular Biology, John Wiley and Sons (1997). Methods for RNA extraction from paraffin embedded tissues are disclosed, for example, in Rupp and Locker, Lab Invest. 56:A67 (1987), and De Andres et al., BioTechniques 18:42044 (1995). In particular, RNA isolation can be performed using a purification kit, buffer set and protease from commercial manufacturers, such as Qiagen, according to the manufacturer's instructions. For example, total RNA from cells in culture can be isolated using Qiagen RNeasy mini-columns. Other commercially available RNA isolation kits include MasterPure™ Complete DNA and RNA Purification Kit (EPICENTRE®, Madison, Wis.), and Paraffin Block RNA Isolation Kit (Ambion, Inc.). Total RNA from tissue samples can be isolated using RNA Stat-60 (Tel-Test). RNA prepared from tumor can be isolated, for example, by cesium chloride density gradient centrifugation.

The sample containing the RNA is then subjected to reverse transcription to produce cDNA from the RNA template, followed by exponential amplification in a PCR reaction. The two most commonly used reverse transcriptases are avilo myeloblastosis virus reverse transcriptase (AMV-RT) and Moloney murine leukemia virus reverse transcriptase (MMLV-RT). The reverse transcription step is typically primed using specific primers, random hexamers, or oligo-dT primers, depending on the circumstances and the goal of expression profiling. For example, extracted RNA can be reverse-transcribed using a GeneAmp RNA PCR kit (Perkin Elmer, Calif., USA), following the manufacturer's instructions. The derived cDNA can then be used as a template in the subsequent PCR reaction.

PCR-based methods use a thermostable DNA-dependent DNA polymerase, such as a Taq DNA polymerase. For example, TaqMan® PCR typically utilizes the 5'-nuclease activity of Taq or Tth polymerase to hydrolyze a hybridization probe bound to its target amplicon, but any enzyme with equivalent 5' nuclease activity can be used. Two oligonucleotide primers are used to generate an amplicon typical of a PCR reaction product. A third oligonucleotide, or probe, can be designed to facilitate detection of a nucleotide sequence of the amplicon located between the hybridization sites the two PCR primers. The probe can be detectably labeled, e.g., with a reporter dye, and can further be provided with both a fluorescent dye, and a quencher fluorescent dye, as in a Taqman® probe configuration. Where a Taqman® probe is used, during the amplification reaction, the Taq DNA polymerase enzyme cleaves the probe in a template-dependent manner. The resultant probe fragments disassociate in solution, and signal from the released reporter dye is free from the quenching effect of the second fluorophore. One molecule of reporter dye is liberated for each new molecule synthesized, and detection of the unquenched reporter dye provides the basis for quantitative interpretation of the data.

TaqMan® RT-PCR can be performed using commercially available equipment, such as, for example, high-throughput platforms such as the ABI PRISM 7700 Sequence Detection System® (Perkin-Elmer-Applied Biosystems, Foster City, Calif., USA), or Lightcycler (Roche Molecular Biochemicals, Mannheim, Germany). In a preferred embodiment, the procedure is run on a LightCycler® 480 (Roche Diagnostics) real-time PCR system, which is a microwell plate-based cycler platform.

5'-Nuclease assay data are commonly initially expressed as a threshold cycle ("$C_T$"). Fluorescence values are recorded during every cycle and represent the amount of product amplified to that point in the amplification reaction. The threshold cycle ($C_T$) is generally described as the point when the fluorescent signal is first recorded as statistically significant. Alternatively, data may be expressed as a crossing point ("Cp"). The Cp value is calculated by determining the second derivatives of entire qPCR amplification curves and their maximum value. The Cp value represents the cycle at which the increase of fluorescence is highest and where the logarithmic phase of a PCR begins.

To minimize errors and the effect of sample-to-sample variation, RT-PCR is usually performed using an internal standard. The ideal internal standard gene (also referred to as a reference gene) is expressed at a quite constant level among cancerous and non-cancerous tissue of the same origin (i.e., a level that is not significantly different among normal and cancerous tissues), and is not significantly affected by the experimental treatment (i.e., does not exhibit a significant difference in expression level in the relevant tissue as a result of exposure to chemotherapy), and expressed at a quite constant level among the same tissue taken from different patients. For example, reference genes useful in the methods disclosed herein should not exhibit significantly different expression levels in cancerous prostate as compared to normal prostate tissue. RNAs frequently used to normalize patterns of gene expression are mRNAs for the housekeeping genes glyceraldehyde-3-phosphate-dehydrogenase (GAPDH) and β-actin. Exemplary reference genes used for normalization comprise one or more of the following genes: AAMP, ARF1, ATP5E, CLTC, GPS1, and PGK1. Gene expression measurements can be normalized relative to the mean of one or more (e.g., 2, 3, 4, 5, or more) reference genes. Reference-normalized expression measurements can range from 2 to 15, where a one unit increase generally reflects a 2-fold increase in RNA quantity.

Real time PCR is compatible both with quantitative competitive PCR, where internal competitor for each target sequence is used for normalization, and with quantitative comparative PCR using a normalization gene contained within the sample, or a housekeeping gene for RT-PCR. For further details see, e.g. Held et al., Genome Research 6:986-994 (1996).

The steps of a representative protocol for use in the methods of the present disclosure use fixed, paraffin-embedded tissues as the RNA source. For example, mRNA isolation, purification, primer extension and amplification can be performed according to methods available in the art. (see, e.g., Godfrey et al. J. Molec. Diagnostics 2: 84-91 (2000); Specht et al., Am. J. Pathol. 158: 419-29 (2001)). Briefly, a representative process starts with cutting about 10 µm thick sections of paraffin-embedded tumor tissue samples. The RNA is then extracted, and protein and DNA depleted from the RNA-containing sample. After analysis of the RNA concentration, RNA is reverse transcribed using gene specific primers followed by RT-PCR to provide for cDNA amplification products.

Design of Intron-Based PCR Primers and Probes

PCR primers and probes can be designed based upon exon or intron sequences present in the mRNA transcript of the gene of interest. Primer/probe design can be performed using publicly available software, such as the DNA BLAT software developed by Kent, W. J., Genome Res. 12(4):656-64 (2002), or by the BLAST software including its variations.

Where necessary or desired, repetitive sequences of the target sequence can be masked to mitigate non-specific signals. Exemplary tools to accomplish this include the Repeat Masker program available on-line through the Baylor College of Medicine, which screens DNA sequences against a library of repetitive elements and returns a query sequence in which the repetitive elements are masked. The masked intron sequences can then be used to design primer and probe sequences using any commercially or otherwise publicly available primer/probe design packages, such as Primer Express (Applied Biosystems); MGB assay-by-design (Applied Biosystems); Primer3 (Steve Rozen and Helen J. Skaletsky (2000) Primer3 on the WWW for general users and for biologist programmers. See S. Rrawetz, S. Misener, Bioinformatics Methods and Protocols: Methods in Molecular Biology, pp. 365-386 (Humana Press).

Other factors that can influence PCR primer design include primer length, melting temperature (Tm), and G/C content, specificity, complementary primer sequences, and 3'-end sequence. In general, optimal PCR primers are generally 17-30 bases in length, and contain about 20-80%, such as, for example, about 50-60% G+C bases, and exhibit Tm's between 50 and 80° C., e.g. about 50 to 70° C.

For further guidelines for PCR primer and probe design see, e.g. Dieffenbach, C W. et al, "General Concepts for PCR Primer Design" in: PCR Primer, A Laboratory Manual, Cold Spring Harbor Laboratory Press, New York, 1995, pp. 133-155; Innis and Gelfand, "Optimization of PCRs" in: PCR Protocols, A Guide to Methods and Applications, CRC Press, London, 1994, pp. 5-11; and Plasterer, T. N. Primerselect: Primer and probe design. Methods Mol. Biol. 70:520-527 (1997), the entire disclosures of which are hereby expressly incorporated by reference.

Table A provides further information concerning the primer, probe, and amplicon sequences associated with the Examples disclosed herein.

MassARRAY® System

In MassARRAY-based methods, such as the exemplary method developed by Sequenom, Inc. (San Diego, Calif.) following the isolation of RNA and reverse transcription, the obtained cDNA is spiked with a synthetic DNA molecule (competitor), which matches the targeted cDNA region in all positions, except a single base, and serves as an internal standard. The cDNA/competitor mixture is PCR amplified and is subjected to a post-PCR shrimp alkaline phosphatase (SAP) enzyme treatment, which results in the dephosphorylation of the remaining nucleotides. After inactivarion of the alkaline phosphatase, the PCR products from the competitor and cDNA are subjected to primer extension, which generates distinct mass signals for the competitor- and cDNA-derives PCR products. After purification, these products are dispensed on a chip array, which is pre-loaded with components needed for analysis with matrix-assisted laser desorption ionization time-of-flight mass spectrometry (MALDI-TOF MS) analysis. The cDNA present in the reaction is then quantified by analyzing the ratios of the peak areas in the mass spectrum generated. For further details see, e.g. Ding and Cantor, Proc. Natl. Acad. Sci. USA 100:3059-3064 (2003).

Other PCR-Based Methods

Further PCR-based techniques that can find use in the methods disclosed herein include, for example, BeadArray® technology (Illumina, San Diego, Calif.; Oliphant et al., Discovery of Markers for Disease (Supplement to Biotechniques), June 2002; Ferguson et al., Analytical Chemistry 72:5618 (2000)); BeadsArray for Detection of Gene Expression® (BADGE), using the commercially available LuminexlOO LabMAP® system and multiple color-coded microspheres (Luminex Corp., Austin, Tex.) in a rapid assay for gene expression (Yang et al., Genome Res. 11:1888-1898 (2001)); and high coverage expression profiling (HiCEP) analysis (Fukumura et al., Nucl. Acids. Res. 31 (16) e94 (2003).

Microarrays

Expression levels of a gene or microArray of interest can also be assessed using the microarray technique. In this method, polynucleotide sequences of interest (including cDNAs and oligonucleotides) are arrayed on a substrate. The arrayed sequences are then contacted under conditions suitable for specific hybridization with detectably labeled cDNA generated from RNA of a test sample. As in the RT-PCR method, the source of RNA typically is total RNA isolated from a tumor sample, and optionally from normal tissue of the same patient as an internal control or cell lines. RNA can be extracted, for example, from frozen or archived paraffin-embedded and fixed (e.g. formalin-fixed) tissue samples.

For example, PCR amplified inserts of cDNA clones of a gene to be assayed are applied to a substrate in a dense array. Usually at least 10,000 nucleotide sequences are applied to the substrate. For example, the microarrayed genes, immobilized on the microchip at 10,000 elements each, are suitable for hybridization under stringent conditions. Fluorescently labeled cDNA probes may be generated through incorporation of fluorescent nucleotides by reverse transcription of RNA extracted from tissues of interest. Labeled cDNA probes applied to the chip hybridize with specificity to each spot of DNA on the array. After washing under stringent conditions to remove non-specifically bound probes, the chip is scanned by confocal laser microscopy or by another detection method, such as a CCD camera. Quantitation of hybridization of each arrayed element allows for assessment of corresponding RNA abundance.

With dual color fluorescence, separately labeled cDNA probes generated from two sources of RNA are hybridized pair wise to the array. The relative abundance of the transcripts from the two sources corresponding to each specified gene is thus determined simultaneously. The miniaturized scale of the hybridization affords a convenient and rapid evaluation of the expression pattern for large numbers of genes. Such methods have been shown to have the sensitivity required to detect rare transcripts, which are expressed at a few copies per cell, and to reproducibly detect at least approximately two-fold differences in the expression levels (Schena et at, Proc. Natl. Acad. Sci. USA 93(2):106-149 (1996)). Microarray analysis can be performed by commercially available equipment, following manufacturer's protocols, such as by using the Affymetrix GenChip® technology, or Incyte's microarray technology.

Serial Analysis of Gene Expression (SAGE)

Serial analysis of gene expression (SAGE) is a method that allows the simultaneous and quantitative analysis of a large number of gene transcripts, without the need of providing an individual hybridization probe for each transcript. First, a short sequence tag (about 10-14 bp) is generated that contains sufficient information to uniquely identify a transcript, provided that the tag is obtained from a unique position within each transcript. Then, many transcripts are linked together to form long serial molecules, that can be sequenced, revealing the identity of the multiple tags simultaneously. The expression pattern of any population of transcripts can be quantitatively evaluated by determining the abundance of individual tags, and identifying the gene corresponding to each tag. For more details see, e.g. Velculescu et al., Science 270:484-487 (1995); and Velculescu et al., Cell 88:243-51 (1997).

Gene Expression Analysis by Nucleic Acid Sequencing

Nucleic acid sequencing technologies are suitable methods for analysis of gene expression. The principle underlying these methods is that the number of times a cDNA sequence is detected in a sample is directly related to the relative expression of the RNA corresponding to that sequence. These methods are sometimes referred to by the term Digital Gene Expression (DGE) to reflect the discrete numeric property of the resulting data. Early methods applying this principle were Serial Analysis of Gene Expression (SAGE) and Massively Parallel Signature Sequencing (MPSS). See, e.g., S. Brenner, et al., Nature Biotechnology 18(6):630-634 (2000). More recently, the advent of "next-generation" sequencing technologies has made DGE simpler, higher throughput, and more affordable. As a result, more laboratories are able to utilize DGE to screen the expression of more genes in more individual patient samples than previously possible. See, e.g., J. Marioni, Genome Research 18(9):1509-1517 (2008); R. Morin, Genome Research 18(4):610-621 (2008); A. Mortazavi, Nature Methods 5(7):621-628 (2008); N. Cloonan, Nature Methods 5(7):613-619 (2008).

Isolating RNA from Body Fluids

Methods of isolating RNA for expression analysis from blood, plasma and serum (see, e.g., K. Enders, et al., Clin Chem 48, 1647-53 (2002) (and references cited therein) and from urine (see, e.g., R. Boom, et al., J Clin Microbiol. 28, 495-503 (1990) and references cited therein) have been described.

Immunohistochemistry

Immunohistochemistry methods are also suitable for detecting the expression levels of genes and applied to the method disclosed herein. Antibodies (e.g., monoclonal antibodies) that specifically bind a gene product of a gene of interest can be used in such methods. The antibodies can be detected by direct labeling of the antibodies themselves, for example, with radioactive labels, fluorescent labels, hapten' labels such as, biotin, or an enzyme such as horse radish peroxidase or alkaline phosphatase. Alternatively, unlabeled primary antibody can be used in conjunction with a labeled secondary antibody specific for the primary antibody. Immunohistochemistry protocols and kits are well known in the art and are commercially available.

Proteomics

The term "proteome" is defined as the totality of the proteins present in a sample (e.g. tissue, organism, or cell culture) at a certain point of time. Proteomics includes, among other things, study of the global changes of protein expression in a sample (also referred to as "expression proteomics"). Proteomics typically includes the following steps: (1) separation of individual proteins in a sample by 2-D gel electrophoresis (2-D PAGE); (2) identification of the individual proteins recovered from the gel, e.g. my mass spectrometry or N-terminal sequencing, and (3) analysis of the data using bioinformatics.

General Description of the mRNA/microRNA Isolation, Purification and Amplification The steps of a representative protocol for profiling gene expression using fixed, paraffin-embedded tissues as the RNA source, including mRNA or microRNA isolation, purification, primer extension and amplification are provided in various published journal articles. (See, e.g., T. E. Godfrey, et al, J. Molec. Diagnostics 2: 84-91 (2000); K. Specht et al., Am. J. Pathol. 158: 419-29 (2001), M. Cronin, et al., Am J Pathol 164:35-42 (2004)). Briefly, a representative process starts with cutting a tissue sample section (e.g. about 10 μm thick sections of a paraffin-embedded tumor tissue sample). The RNA is then extracted, and protein and DNA are removed. After analysis of the RNA concentration, RNA repair is performed if desired. The sample can then be subjected to analysis, e.g., by reverse transcribed using gene specific promoters followed by RT-PCR.

Statistical Analysis of Expression Levels in Identification of Genes and MicroRNAs One skilled in the art will recognize that there are many statistical methods that may be used to determine whether there is a significant relationship between a parameter of interest (e.g., recurrence) and expression levels of a marker gene/microRNA as described here. In an exemplary embodiment, the present invention provides a stratified cohort sampling design (a form of case-control sampling) using tissue and data from prostate cancer patients. Selection of specimens was stratified by T stage (T1, T2), year cohort (<1993, ≥1993), and prostatectomy Gleason Score (low/intermediate, high). All patients with clinical recurrence were selected and a sample of patients who did not experience a clinical recurrence was selected. For each patient, up to two enriched tumor specimens and one normal-appearing tissue sample was assayed.

All hypothesis tests were reported using two-sided p-values. To investigate if there is a significant relationship of outcomes (clinical recurrence-free interval (cRFI), biochemical recurrence-free interval (bRFI), prostate cancer-specific survival (PCSS), and overall survival (OS)) with individual genes and/or microRNAs, demographic or clinical covariates Cox Proportional Hazards (PH) models using maximum weighted pseudo partial-likelihood estimators were used and p-values from Wald tests of the null hypothesis that the hazard ratio (HR) is one are reported. To investigate if there is a significant relationship between individual genes and/or microRNAs and Gleason pattern of a particular sample, ordinal logistic regression models using maximum weighted likelihood methods were used and p-values from Wald tests of the null hypothesis that the odds ratio (OR) is one are reported.

Coexpression Analysis

The present disclosure provides a method to determine tumor stage based on the expression of staging genes, or genes that co-express with particular staging genes. To perform particular biological processes, genes often work together in a concerted way, i.e. they are co-expressed. Co-expressed gene groups identified for a disease process like cancer can serve as biomarkers for tumor status and disease progression. Such co-expressed genes can be assayed in lieu of, or in addition to, assaying of the staging gene with which they are co-expressed.

In an exemplary embodiment, the joint correlation of gene expression levels among prostate cancer specimens under study may be assessed. For this purpose, the correlation structures among genes and specimens may be examined through hierarchical cluster methods. This information may be used to confirm that genes that are known to be highly correlated in prostate cancer specimens cluster together as expected. Only genes exhibiting a nominally significant (unadjusted p<0.05) relationship with cRFI in the univariate Cox PH regression analysis will be included in these analyses.

One skilled in the art will recognize that many co-expression analysis methods now known or later developed will fall within the scope and spirit of the present invention.

These methods may incorporate, for example, correlation coefficients, co-expression network analysis, clique analysis, etc., and may be based on expression data from RT-PCR, microarrays, sequencing, and other similar technologies. For example, gene expression clusters can be identified using pair-wise analysis of correlation based on Pearson or Spearman correlation coefficients. (See, e.g., Pearson K. and Lee A., Biometrika 2, 357 (1902); C. Spearman, Amer. J. Psychol 15:72-101 (1904); J. Myers, A. Well, Research Design and Statistical Analysis, p. 508 (2nd Ed., 2003).)

Normalization of Expression Levels

The expression data used in the methods disclosed herein can be normalized. Normalization refers to a process to correct for (normalize away), for example, differences in the amount of RNA assayed and variability in the quality of the RNA used, to remove unwanted sources of systematic variation in Ct or Cp measurements, and the like. With respect to RT-PCR experiments involving archived fixed paraffin embedded tissue samples, sources of systematic variation are known to include the degree of RNA degradation relative to the age of the patient sample and the type of fixative used to store the sample. Other sources of systematic variation are attributable to laboratory processing conditions.

Assays can provide for normalization by incorporating the expression of certain normalizing genes, which do not significantly differ in expression levels under the relevant conditions. Exemplary normalization genes disclosed herein include housekeeping genes. (See, e.g., E. Eisenberg, et al., Trends in Genetics 19(7):362-365 (2003).) Normalization can be based on the mean or median signal (Ct or Cp) of all of the assayed genes or a large subset thereof (global normalization approach). In general, the normalizing genes, also referred to as reference genes should be genes that are known not to exhibit significantly different expression in prostate cancer as compared to non-cancerous prostate tissue, and are not significantly affected by various sample and process conditions, thus provide for normalizing away extraneous effects.

In exemplary embodiments, one or more of the following genes are used as references by which the mRNA or microRNA expression data is normalized: AAMP, ARF1, ATP5E, CLTC, GPS1, and PGK1. In another exemplary embodiment, one or more of the following microRNAs are used as references by which the expression data of microRNAs are normalized: hsa-miR-106a; hsa-miR-146b-5p; hsa-miR-191; hsa-miR-19b; and hsa-miR-92a. The calibrated weighted average $C_T$ or Cp measurements for each of the prognostic and predictive genes or microRNAs may be normalized relative to the mean of five or more reference genes or microRNAs.

Those skilled in the art will recognize that normalization may be achieved in numerous ways, and the techniques described above are intended only to be exemplary, not exhaustive.

Standardization of Expression Levels

The expression data used in the methods disclosed herein can be standardized. Standardization refers to a process to effectively put all the genes or microRNAs on a comparable scale. This is performed because some genes or microRNAs will exhibit more variation (a broader range of expression) than others. Standardization is performed by dividing each expression value by its standard deviation across all samples for that gene or microRNA. Hazard ratios are then interpreted as the relative risk of recurrence per 1 standard deviation increase in expression.

Kits of the Invention

The materials for use in the methods of the present invention are suited for preparation of kits produced in accordance with well-known procedures. The present disclosure thus provides kits comprising agents, which may include gene (or microRNA)-specific or gene (or microRNA)-selective probes and/or primers, for quantifying the expression of the disclosed genes or microRNAs for predicting prognostic outcome or response to treatment. Such kits may optionally contain reagents for the extraction of RNA from tumor samples, in particular fixed paraffin-embedded tissue samples and/or reagents for RNA amplification. In addition, the kits may optionally comprise the reagent(s) with an identifying description or label or instructions relating to their use in the methods of the present invention. The kits may comprise containers (including microliter plates suitable for use in an automated implementation of the method), each with one or more of the various materials or reagents (typically in concentrated form) utilized in the methods, including, for example, chromatographic columns, pre-fabricated microarrays, buffers, the appropriate nucleotide triphosphates (e.g., dATP, dCTP, dGTP and dTTP; or rATP, rCTP, rGTP and UTP), reverse transcriptase, DNA polymerase, RNA polymerase, and one or more probes and primers of the present invention (e.g., appropriate length poly(T) or random primers linked to a promoter reactive with the RNA polymerase). Mathematical algorithms used to estimate or quantify prognostic or predictive information are also properly potential components of kits.

Reports

The methods of this invention, when practiced for commercial diagnostic purposes, generally produce a report or summary of information obtained from the herein-described methods. For example, a report may include information concerning expression levels of one or more genes and/or microRNAs, classification of the tumor or the patient's risk of recurrence, the patient's likely prognosis or risk classification, clinical and pathologic factors, and/or other information. The methods and reports of this invention can further include storing the report in a database. The method can create a record in a database for the subject and populate the record with data. The report may be a paper report, an auditory report, or an electronic record. The report may be displayed and/or stored on a computing device (e.g., handheld device, desktop computer, smart device, website, etc.). It is contemplated that the report is provided to a physician and/or the patient. The receiving of the report can further include establishing a network connection to a server computer that includes the data and report and requesting the data and report from the server computer.

Computer Program

The values from the assays described above, such as expression data, can be calculated and stored manually. Alternatively, the above-described steps can be completely or partially performed by a computer program product. The present invention thus provides a computer program product including a computer readable storage medium having a computer program stored on it. The program can, when read by a computer, execute relevant calculations based on values obtained from analysis of one or more biological sample from an individual (e.g., gene expression levels, normalization, standardization, thresholding, and conversion of values from assays to a score and/or text or graphical depiction of tumor stage and related information). The computer program product has stored therein a computer program for performing the calculation.

The present disclosure provides systems for executing the program described above, which system generally includes: a) a central computing environment; b) an input device, operatively connected to the computing environment, to receive patient data, wherein the patient data can include, for example, expression level or other value obtained from an assay using a biological sample from the patient, or microarray data, as described in detail above; c) an output device, connected to the computing environment, to provide information to a user (e.g., medical personnel); and d) an algorithm executed by the central computing environment (e.g., a processor), where the algorithm is executed based on the data received by the input device, and wherein the algorithm calculates an expression score, thresholding, or other functions described herein. The methods provided by the present invention may also be automated in whole or in part.

All aspects of the present invention may also be practiced such that a limited number of additional genes and/or microRNAs that are co-expressed or functionally related with the disclosed genes, for example as evidenced by statistically meaningful Pearson and/or Spearman correlation coefficients, are included in a test in addition to and/or in place of disclosed genes.

Having described the invention, the same will be more readily understood through reference to the following Examples, which are provided by way of illustration, and are not intended to limit the invention in any way.

EXAMPLES

Example 1: RNA Yield and Gene Expression Profiles in Prostate Cancer Biopsy Cores Clinical tools based on prostate needle core biopsies are needed to guide treatment planning at diagnosis for men with localized prostate cancer. Limiting tissue in needle core biopsy specimens poses significant challenges to the development of molecular diagnostic tests. This study examined RNA extraction yields and gene expression profiles using an RT-PCR assay to characterize RNA from manually microdissected fixed paraffin embedded (FPE) prostate cancer needle biopsy cores. It also investigated the association of RNA yields and gene expression profiles with Gleason score in these specimens.

Patients and Samples

This study determined the feasibility of gene expression profile analysis in prostate cancer needle core biopsies by evaluating the quantity and quality of RNA extracted from fixed paraffin-embedded (FPE) prostate cancer needle core biopsy specimens. Forty-eight (48) formalin-fixed blocks from prostate needle core biopsy specimens were used for this study. Classification of specimens was based on interpretation of the Gleason score (2005 Int'l Society of Urological Pathology Consensus Conference) and percentage tumor (<33%, 33-66%, >66%) involvement as assessed by pathologists.

Table 1

| Distribution of cases | | | |
| --- | --- | --- | --- |
| Gleason score Category | ~<33% Tumor | ~33-66% Tumor | ~>66% Tumor |
| Low (≤6) | 5 | 5 | 6 |
| Intermediate (7) | 5 | 5 | 6 |
| High (8, 9, 10) | 5 | 5 | 6 |
| Total | 15 | 15 | 18 |

Assay Methods

Fourteen (14) serial 5 μm unstained sections from each FPE tissue block were included in the study. The first and last sections for each case were H&E stained and histologically reviewed to confirm the presence of tumor and for tumor enrichment by manual micro-dissection.

RNA from enriched tumor samples was extracted using a manual RNA extraction process. RNA was quantitated using the RiboGreen® assay and tested for the presence of genomic DNA contamination. Samples with sufficient RNA yield and free of genomic DNA tested for gene expression levels of a 24-gene panel of reference and cancer-related genes using quantitative RT-PCR. The expression was normalized to the average of 6 reference genes (AAMP, ARF1, ATP5E, CLTC, EEF1A1, and GPX1).

Statistical Methods

Descriptive statistics and graphical displays were used to summarize standard pathology metrics and gene expression, with stratification for Gleason Score category and percentage tumor involvement category. Ordinal logistic regression was used to evaluate the relationship between gene expression and Gleason Score category.

Results

The RNA yield per unit surface area ranged from 16 to 2406 ng/mm2. Higher RNA yield was observed in samples with higher percent tumor involvement (p=0.02) and higher Gleason score (p=0.01). RNA yield was sufficient (>200 ng) in 71% of cases to permit 96-well RT-PCR, with 87% of cases having >100 ng RNA yield. The study confirmed that gene expression from prostate biopsies, as measured by qRT-PCR, was comparable to FPET samples used in commercial molecular assays for breast cancer. In addition, it was observed that greater biopsy RNA yields are found with higher Gleason score and higher percent tumor involvement. Nine genes were identified as significantly associated with Gleason score (p<0.05) and there was a large dynamic range observed for many test genes.

Example 2: Gene Expression Analysis for Genes Associated with Prognosis in Prostate Cancer Patients and Samples Approximately 2600 patients with clinical stage T1/T2 prostate cancer treated with radical prostatectomy (RP) at the Cleveland Clinic between 1987 and 2004 were identified. Patients were excluded from the study design if they received neo-adjuvant and/or adjuvant therapy, if pre-surgical PSA levels were missing, or if no tumor block was available from initial diagnosis. 127 patients with clinical recurrence and 374 patients without clinical recurrence after radical prostatectomy were randomly selected using a cohort sampling design. The specimens were stratified by T stage (T1, T2), year cohort (<1993, ≥1993), and prostatectomy Gleason score (low/intermediate, high). Of the 501 sampled patients, 51 were excluded for insufficient tumor; 7 were excluded due to clinical ineligibility; 2 were excluded due to poor quality of gene expression data; and 10 were excluded because primary Gleason pattern was unavailable. Thus, this gene expression study included tissue and data from 111 patients with clinical recurrence and 330 patients without clinical recurrence after radical prostatectomies performed between 1987 and 2004 for treatment of early stage (T1, T2) prostate cancer.

Two fixed paraffin embedded (FPE) tissue specimens were obtained from prostate tumor specimens in each patient. The sampling method (sampling method A or B) depended on whether the highest Gleason pattern is also the primary Gleason pattern. For each specimen selected, the invasive cancer cells were at least 5.0 mm in dimension, except in the instances of pattern 5, where 2.2 mm was accepted. Specimens were spatially distinct where possible.

TABLE 2

Sampling Methods

| Sampling Method A | Sampling Method B |
|---|---|
| For patients whose prostatectomy primary Gleason pattern is also the highest Gleason pattern | For patients whose prostatectomy primary Gleason pattern is not the highest Gleason pattern |
| Specimen 1 (A1) = primary Gleason pattern Select and mark largest focus (greatest cross-sectional area) of primary Gleason pattern tissue. Invasive cancer area ≥5.0 mm. | Specimen 1 (B1) = highest Gleason pattern Select highest Gleason pattern tissue from spatially distinct area from specimen B2, if possible. Invasive cancer area at least 5.0 mm if selecting secondary pattern, at least 2.2 mm if selecting Gleason pattern 5. |
| Specimen 2 (A2) = secondary Gleason pattern | Specimen 2 (B2) = primary Gleason pattern |
| Select and mark secondary Gleason pattern tissue from spatially distinct area from specimen A1. Invasive cancer area ≥5.0 mm. | Select largest focus (greatest cross-sectional area) of primary Gleason pattern tissue. Invasive cancer area ≥5.0 mm. |

Histologically normal appearing tissue (NAT) adjacent to the tumor specimen (also referred to in these Examples as "non-tumor tissue") was also evaluated. Adjacent tissue was collected 3 mm from the tumor to 3 mm from the edge of the FPET block. NAT was preferentially sampled adjacent to the primary Gleason pattern. In cases where there was insufficient NAT adjacent to the primary Gleason pattern, then NAT was sampled adjacent to the secondary or highest Gleason pattern (A2 or B1) per the method set forth in Table 2. Six (6) 10 μm sections with beginning H&E at 5 μm and ending unstained slide at 5 μm were prepared from each fixed paraffin-embedded tumor (FPET) block included in the study. All cases were histologically reviewed and manually micro-dissected to yield two enriched tumor samples and, where possible, one normal tissue sample adjacent to the tumor specimen.

Assay Method

In this study, RT-PCR analysis was used to determine RNA expression levels for 738 genes and chromosomal rearrangements (e.g., TMPRSS2-ERG fusion or other ETS family genes) in prostate cancer tissue and surrounding NAT in patients with early-stage prostate cancer treated with radical prostatectomy.

The samples were quantified using the RiboGreen assay and a subset tested for presence of genomic DNA contamination. Samples were taken into reverse transcription (RT) and quantitative polymerase chain reaction (qPCR). All analyses were conducted on reference-normalized gene expression levels using the average of the of replicate well crossing point (CP) values for the 6 reference genes (AAMP, ARF1, ATP5E, CLTC, GPS1, PGK1).

Statistical Analysis and Results

Primary statistical analyses involved 111 patients with clinical recurrence and 330 patients without clinical recurrence after radical prostatectomy for early-stage prostate cancer stratified by T-stage (T1, T2), year cohort (<1993, ≥1993), and prostatectomy Gleason score (low/intermediate, high). Gleason score categories are defined as follows: low (Gleason score≤6), intermediate (Gleason score=7), and high (Gleason score≥8). A patient was included in a specified analysis if at least one sample for that patient was evaluable. Unless otherwise stated, all hypothesis tests were reported using two-sided p-values. The method of Storey was applied to the resulting set of p-values to control the false discovery rate (FDR) at 20%. J. Storey, R. Tibshirani, Estimating the Positive False Discovery Rate Under Dependence, with Applications to DNA Microarrays, Dept. of Statistics, Stanford Univ. (2001).

Analysis of gene expression and recurrence-free interval was based on univariate Cox Proportional Hazards (PH) models using maximum weighted pseudo-partial-likelihood estimators for each evaluable gene in the gene list (727 test genes and 5 reference genes). P-values were generated using Wald tests of the null hypothesis that the hazard ratio (HR) is one. Both unadjusted p-values and the q-value (smallest FDR at which the hypothesis test in question is rejected) were reported. Un-adjusted p-values <0.05 were considered statistically significant. Since two tumor specimens were selected for each patient, this analysis was performed using the 2 specimens from each patient as follows: (1) analysis using the primary Gleason pattern specimen from each patient (Specimens A1 and B2 as described in Table 2); (2) analysis using the highest Gleason pattern specimen from each patient (Specimens A1 and B1 as described in Table 2).

Analysis of gene expression and Gleason pattern (3, 4, 5) was based on univariate ordinal logistic regression models using weighted maximum likelihood estimators for each gene in the gene list (727 test genes and 5 reference genes). P-values were generated using a Wald test of the null hypothesis that the odds ratio (OR) is one. Both unadjusted p-values and the q-value (smallest FDR at which the hypothesis test in question is rejected) were reported. Un-adjusted p-values <0.05 were considered statistically significant. Since two tumor specimens were selected for each patient, this analysis was performed using the 2 specimens from each patient as follows: (1) analysis using the primary Gleason pattern specimen from each patient (Specimens A1 and B2 as described in Table 2); (2) analysis using the highest Gleason pattern specimen from each patient (Specimens A1 and B1 as described in Table 2).

It was determined whether there is a significant relationship between cRFI and selected demographic, clinical, and pathology variables, including age, race, clinical tumor stage, pathologic tumor stage, location of selected tumor specimens within the prostate (peripheral versus transitional zone), PSA at the time of surgery, overall Gleason score from the radical prostatectomy, year of surgery, and specimen Gleason pattern. Separately for each demographic or clinical variable, the relationship between the clinical covariate and cRFI was modeled using univariate Cox PH regression using weighted pseudo partial-likelihood estimators and a p-value was generated using Wald's test of the null hypothesis that the hazard ratio (HR) is one. Covariates with unadjusted p-values <0.2 may have been included in the covariate-adjusted analyses.

It was determined whether there was a significant relationship between each of the individual cancer-related genes and cRFI after controlling for important demographic and clinical covariates. Separately for each gene, the relationship between gene expression and cRFI was modeled using multivariate Cox PH regression using weighted pseudo partial-likelihood estimators including important demographic and clinical variables as covariates. The independent contribution of gene expression to the prediction of cRFI was tested by generating a p-value from a Wald test using a model that included clinical covariates for each nodule (specimens as defined in Table 2). Un-adjusted p-values <0.05 were considered statistically significant.

Tables 3A and 3B provide genes significantly associated (p<0.05), positively or negatively, with Gleason pattern in the primary and/or highest Gleason pattern. Increased expression of genes in Table 3A is positively associated with higher Gleason score, while increased expression of genes in Table 3B are negatively associated with higher Gleason score.

TABLE 3A

Gene significantly (p < 0.05) associated with Gleason pattern for all specimens in the primary Gleason pattern or highest Gleason pattern odds ratio (OR) > 1.0 (Increased expression is positively associated with higher Gleason Score)

| Official Symbol | Primary Pattern | | Highest Pattern | |
|---|---|---|---|---|
| | OR | p-value | OR | p-value |
| ALCAM | 1.73 | <.001 | 1.36 | 0.009 |
| ANLN | 1.35 | 0.027 | | |
| APOC1 | 1.47 | 0.005 | 1.61 | <.001 |
| APOE | 1.87 | <.001 | 2.15 | <.001 |
| ASAP2 | 1.53 | 0.005 | | |
| ASPN | 2.62 | <.001 | 2.13 | <.001 |
| ATP5E | 1.35 | 0.035 | | |
| AURKA | 1.44 | 0.010 | | |
| AURKB | 1.59 | <.001 | 1.56 | <.001 |
| BAX | 1.43 | 0.006 | | |
| BGN | 2.58 | <.001 | 2.82 | <.001 |
| BIRC5 | 1.45 | 0.003 | 1.79 | <.001 |
| BMP6 | 2.37 | <.001 | 1.68 | <.001 |
| BMPR1B | 1.58 | 0.002 | | |
| BRCA2 | | | 1.45 | 0.013 |
| BUB1 | 1.73 | <.001 | 1.57 | <.001 |
| CACNA1D | 1.31 | 0.045 | 1.31 | 0.033 |
| CADPS | | | 1.30 | 0.023 |
| CCNB1 | 1.43 | 0.023 | | |
| CCNE2 | 1.52 | 0.003 | 1.32 | 0.035 |
| CD276 | 2.20 | <.001 | 1.83 | <.001 |
| CD68 | | | 1.36 | 0.022 |
| CDC20 | 1.69 | <.001 | 1.95 | <.001 |
| CDC6 | 1.38 | 0.024 | 1.46 | <.001 |
| CDH11 | | | 1.30 | 0.029 |
| CDKN2B | 1.55 | 0.001 | 1.33 | 0.023 |
| CDKN2C | 1.62 | <.001 | 1.52 | <.001 |
| CDKN3 | 1.39 | 0.010 | 1.50 | 0.002 |
| CENPF | 1.96 | <.001 | 1.71 | <.001 |
| CHRAC1 | | | 1.34 | 0.022 |
| CLDN3 | | | 1.37 | 0.029 |
| COL1A1 | 2.23 | <.001 | 2.22 | <.001 |
| COL1A2 | | | 1.42 | 0.005 |
| COL3A1 | 1.90 | <.001 | 2.13 | <.001 |
| COL8A1 | 1.88 | <.001 | 2.35 | <.001 |
| CRISP3 | 1.33 | 0.040 | 1.26 | 0.050 |
| CTHRC1 | 2.01 | <.001 | 1.61 | <.001 |
| CTNND2 | 1.48 | 0.007 | 1.37 | 0.011 |
| DAPK1 | 1.44 | 0.014 | | |
| DIAPH1 | 1.34 | 0.032 | 1.79 | <.001 |
| DIO2 | | | 1.56 | 0.001 |

TABLE 3A-continued

Gene significantly (p < 0.05) associated with Gleason pattern for all specimens in the primary Gleason pattern or highest Gleason pattern odds ratio (OR) > 1.0 (Increased expression is positively associated with higher Gleason Score)

| Official Symbol | Primary Pattern | | Highest Pattern | |
|---|---|---|---|---|
| | OR | p-value | OR | p-value |
| DLL4 | 1.38 | 0.026 | 1.53 | <.001 |
| ECE1 | 1.54 | 0.012 | 1.40 | 0.012 |
| ENY2 | 1.35 | 0.046 | 1.35 | 0.012 |
| EZH2 | 1.39 | 0.040 | | |
| F2R | 2.37 | <.001 | 2.60 | <.001 |
| FAM49B | 1.57 | 0.002 | 1.33 | 0.025 |
| FAP | 2.36 | <.001 | 1.89 | <.001 |
| FCGR3A | 2.10 | <.001 | 1.83 | <.001 |
| GNPTAB | 1.78 | <.001 | 1.54 | <.001 |
| GSK3B | | | 1.39 | 0.018 |
| HRAS | 1.62 | 0.003 | | |
| HSD17B4 | 2.91 | <.001 | 1.57 | <.001 |
| HSPA8 | 1.48 | 0.012 | 1.34 | 0.023 |
| IFI30 | 1.64 | <.001 | 1.45 | 0.013 |
| IGFBP3 | | | 1.29 | 0.037 |
| IL11 | 1.52 | 0.001 | 1.31 | 0.036 |
| INHBA | 2.55 | <.001 | 2.30 | <.001 |
| ITGA4 | | | 1.35 | 0.028 |
| JAG1 | 1.68 | <.001 | 1.40 | 0.005 |
| KCNN2 | 1.50 | 0.004 | | |
| KCTD12 | | | 1.38 | 0.012 |
| KHDRBS3 | 1.85 | <.001 | 1.72 | <.001 |
| KIF4A | 1.50 | 0.010 | 1.50 | <.001 |
| KLK14 | 1.49 | 0.001 | 1.35 | <.001 |
| KPNA2 | 1.68 | 0.004 | 1.65 | 0.001 |
| KRT2 | | | 1.33 | 0.022 |
| KRT75 | | | 1.27 | 0.028 |
| LAMC1 | 1.44 | 0.029 | | |
| LAPTM5 | 1.36 | 0.025 | 1.31 | 0.042 |
| LTBP2 | 1.42 | 0.023 | 1.66 | <.001 |
| MANF | | | 1.34 | 0.019 |
| MAOA | 1.55 | 0.003 | 1.50 | <.001 |
| MAP3K5 | 1.55 | 0.006 | 1.44 | 0.001 |
| MDK | 1.47 | 0.013 | 1.29 | 0.041 |
| MDM2 | | | 1.31 | 0.026 |
| MELK | 1.64 | <.001 | 1.64 | <.001 |
| MMP11 | 2.33 | <.001 | 1.66 | <.001 |
| MYBL2 | 1.41 | 0.007 | 1.54 | <.001 |
| MYO6 | | | 1.32 | 0.017 |
| NETO2 | | | 1.36 | 0.018 |
| NOX4 | 1.84 | <.001 | 1.73 | <.001 |
| NPM1 | 1.68 | 0.001 | | |
| NRIP3 | | | 1.36 | 0.009 |
| NRP1 | 1.80 | 0.001 | 1.36 | 0.019 |
| OSM | 1.33 | 0.046 | | |
| PATE1 | 1.38 | 0.032 | | |
| PECAM1 | 1.38 | 0.021 | 1.31 | 0.035 |
| PGD | 1.56 | 0.010 | | |
| PLK1 | 1.51 | 0.004 | 1.49 | 0.002 |
| PLOD2 | | | 1.29 | 0.027 |
| POSTN | 1.70 | 0.047 | 1.55 | 0.006 |
| PPP3CA | 1.38 | 0.037 | 1.37 | 0.006 |
| PTK6 | 1.45 | 0.007 | 1.53 | <.001 |
| PTTG1 | | | 1.51 | <.001 |
| RAB31 | | | 1.31 | 0.030 |
| RAD21 | 2.05 | <.001 | 1.38 | 0.020 |
| RAD51 | 1.46 | 0.002 | 1.26 | 0.035 |
| RAF1 | 1.46 | 0.017 | | |
| RALBP1 | 1.37 | 0.043 | | |
| RHOC | | | 1.33 | 0.021 |
| ROBO2 | 1.52 | 0.003 | 1.41 | 0.006 |
| RRM2 | 1.77 | <.001 | 1.50 | <.001 |
| SAT1 | 1.67 | 0.002 | 1.61 | <.001 |
| SDC1 | 1.66 | 0.001 | 1.46 | 0.014 |
| SEC14L1 | 1.53 | 0.003 | 1.62 | <.001 |
| SESN3 | 1.76 | <.001 | 1.45 | <.001 |
| SFRP4 | 2.69 | <.001 | 2.03 | <.001 |
| SHMT2 | 1.69 | 0.007 | 1.45 | 0.003 |
| SKIL | | | 1.46 | 0.005 |
| SOX4 | 1.42 | 0.016 | 1.27 | 0.031 |
| SPARC | 1.40 | 0.024 | 1.55 | <.001 |

TABLE 3A-continued

Gene significantly (p < 0.05) associated with Gleason pattern for all specimens in the primary Gleason pattern or highest Gleason pattern odds ratio (OR) > 1.0 (Increased expression is positively associated with higher Gleason Score)

| Official Symbol | Primary Pattern OR | p-value | Highest Pattern OR | p-value |
|---|---|---|---|---|
| SPINK1 | | | 1.29 | 0.002 |
| SPP1 | 1.51 | 0.002 | 1.80 | <.001 |
| TFDP1 | 1.48 | 0.014 | | |
| THBS2 | 1.87 | <.001 | 1.65 | <.001 |
| THY1 | 1.58 | 0.003 | 1.64 | <.001 |
| TK1 | 1.79 | <.001 | 1.42 | 0.001 |
| TOP2A | 2.30 | <.001 | 2.01 | <.001 |
| TPD52 | 1.95 | <.001 | 1.30 | 0.037 |
| TPX2 | 2.12 | <.001 | 1.86 | <.001 |
| TYMP | 1.36 | 0.020 | | |
| TYMS | 1.39 | 0.012 | 1.31 | 0.036 |
| UBE2C | 1.66 | <.001 | 1.65 | <.001 |
| UBE2T | 1.59 | <.001 | 1.33 | 0.017 |
| UGDH | | | 1.28 | 0.049 |
| UGT2B15 | 1.46 | 0.001 | 1.25 | 0.045 |
| UHRF1 | 1.95 | <.001 | 1.62 | <.001 |
| VDR | 1.43 | 0.010 | 1.39 | 0.018 |
| WNT5A | 1.54 | 0.001 | 1.44 | 0.013 |

TABLE 3B

Gene significantly (p < 0.05) associated with Gleason pattern for all specimens in the primary Gleason pattern or highest Gleason pattern odds ratio (OR) < 1.0 (Increased expression is negatively associated with higher Gleason score)

| Official Symbol | Primary Pattern OR | p-value | Highest Pattern OR | p-value |
|---|---|---|---|---|
| ABCA5 | 0.78 | 0.041 | | |
| ABCG2 | 0.65 | 0.001 | 0.72 | 0.012 |
| ACOX2 | 0.44 | <.001 | 0.53 | <.001 |
| ADH5 | 0.45 | <.001 | 0.42 | <.001 |
| AFAP1 | | | 0.79 | 0.038 |
| AIG1 | | | 0.77 | 0.024 |
| AKAP1 | 0.63 | 0.002 | | |
| AKR1C1 | 0.66 | 0.003 | 0.63 | <.001 |
| AKT3 | 0.68 | 0.006 | 0.77 | 0.010 |
| ALDH1A2 | 0.28 | <.001 | 0.33 | <.001 |
| ALKBH3 | 0.77 | 0.040 | 0.77 | 0.029 |
| AMPD3 | 0.67 | 0.007 | | |
| ANPEP | 0.68 | 0.008 | 0.59 | <.001 |
| ANXA2 | 0.72 | 0.018 | | |
| APC | | | 0.69 | 0.002 |
| AXIN2 | 0.46 | <.001 | 0.54 | <.001 |
| AZGP1 | 0.52 | <.001 | 0.53 | <.001 |
| BIK | 0.69 | 0.006 | 0.73 | 0.003 |
| BIN1 | 0.43 | <.001 | 0.61 | <.001 |
| BTG3 | | | 0.79 | 0.030 |
| BTRC | 0.48 | <.001 | 0.62 | <.001 |
| C7 | 0.37 | <.001 | 0.55 | <.001 |
| CADM1 | 0.56 | <.001 | 0.69 | 0.001 |
| CAV1 | 0.58 | 0.002 | 0.70 | 0.009 |
| CAV2 | 0.65 | 0.029 | | |
| CCNH | 0.67 | 0.006 | 0.77 | 0.048 |
| CD164 | 0.59 | 0.003 | 0.57 | <.001 |
| CDC25B | 0.77 | 0.035 | | |
| CDH1 | | | 0.66 | <.001 |
| CDK2 | | | 0.71 | 0.003 |
| CDKN1C | 0.58 | <.001 | 0.57 | <.001 |
| CDS 2 | | | 0.69 | 0.002 |
| CHN1 | 0.66 | 0.002 | | |
| COL6A1 | 0.44 | <.001 | 0.66 | <.001 |
| COL6A3 | 0.66 | 0.006 | | |
| CSRP1 | 0.42 | 0.006 | | |
| CTGF | 0.74 | 0.043 | | |
| CTNNA1 | 0.70 | <.001 | 0.83 | 0.018 |

TABLE 3B-continued

Gene significantly (p < 0.05) associated with Gleason pattern for all specimens in the primary Gleason pattern or highest Gleason pattern odds ratio (OR) < 1.0 (Increased expression is negatively associated with higher Gleason score)

| Official Symbol | Primary Pattern OR | p-value | Highest Pattern OR | p-value |
|---|---|---|---|---|
| CTNNB1 | 0.70 | 0.019 | | |
| CTNND1 | | | 0.75 | 0.028 |
| CUL1 | | | 0.74 | 0.011 |
| CXCL12 | 0.54 | <.001 | 0.74 | 0.006 |
| CYP3A5 | 0.52 | <.001 | 0.66 | 0.003 |
| CYR61 | 0.64 | 0.004 | 0.68 | 0.005 |
| DDR2 | 0.57 | 0.002 | 0.73 | 0.004 |
| DES | 0.34 | <.001 | 0.58 | <.001 |
| DLGAP1 | 0.54 | <.001 | 0.62 | <.001 |
| DNM3 | 0.67 | 0.004 | | |
| DPP4 | 0.41 | <.001 | 0.53 | <.001 |
| DPT | 0.28 | <.001 | 0.48 | <.001 |
| DUSP1 | 0.59 | <.001 | 0.63 | <.001 |
| EDNRA | 0.64 | 0.004 | 0.74 | 0.008 |
| EGF | | | 0.71 | 0.012 |
| EGR1 | 0.59 | <.001 | 0.67 | 0.009 |
| EGR3 | 0.72 | 0.026 | 0.71 | 0.025 |
| EIF5 | | | 0.76 | 0.025 |
| ELK4 | 0.58 | 0.001 | 0.70 | 0.008 |
| ENPP2 | 0.66 | 0.002 | 0.70 | 0.005 |
| EPHA3 | 0.65 | 0.006 | | |
| EPHB2 | 0.60 | <.001 | 0.78 | 0.023 |
| EPHB4 | 0.75 | 0.046 | 0.73 | 0.006 |
| ERBB3 | 0.76 | 0.040 | 0.75 | 0.013 |
| ERBB4 | | | 0.74 | 0.023 |
| ERCC1 | 0.63 | <.001 | 0.77 | 0.016 |
| FAAH | 0.67 | 0.003 | 0.71 | 0.010 |
| FAM107A | 0.35 | <.001 | 0.59 | <.001 |
| FAM13C | 0.37 | <.001 | 0.48 | <.001 |
| FAS | 0.73 | 0.019 | 0.72 | 0.008 |
| FGF10 | 0.53 | <.001 | 0.58 | <.001 |
| FGF7 | 0.52 | <.001 | 0.59 | <.001 |
| FGFR2 | 0.60 | <.001 | 0.59 | <.001 |
| FKBP5 | 0.70 | 0.039 | 0.68 | 0.003 |
| FLNA | 0.39 | <.001 | 0.56 | <.001 |
| FLNC | 0.33 | <.001 | 0.52 | <.001 |
| FOS | 0.58 | <.001 | 0.66 | 0.005 |
| FOXO1 | 0.57 | <.001 | 0.67 | <.001 |
| FOXQ1 | | | 0.74 | 0.023 |
| GADD45B | 0.62 | 0.002 | 0.71 | 0.010 |
| GHR | 0.62 | 0.002 | 0.72 | 0.009 |
| GNRH1 | 0.74 | 0.049 | 0.75 | 0.026 |
| GPM6B | 0.48 | <.001 | 0.68 | <.001 |
| GPS1 | | | 0.68 | 0.003 |
| GSN | 0.46 | <.001 | 0.77 | 0.027 |
| GSTM1 | 0.44 | <.001 | 0.62 | <.001 |
| GSTM2 | 0.29 | <.001 | 0.49 | <.001 |
| HGD | | | 0.77 | 0.020 |
| HIRIP3 | 0.75 | 0.034 | | |
| HK1 | 0.48 | <.001 | 0.66 | 0.001 |
| HLF | 0.42 | <.001 | 0.55 | <.001 |
| HNF1B | 0.67 | 0.006 | 0.74 | 0.010 |
| HPS1 | 0.66 | 0.001 | 0.65 | <.001 |
| HSP90AB1 | 0.75 | 0.042 | | |
| HSPA5 | 0.70 | 0.011 | | |
| HSPB2 | 0.52 | <.001 | 0.70 | 0.004 |
| IGF1 | 0.35 | <.001 | 0.59 | <.001 |
| IGF2 | 0.48 | <.001 | 0.70 | 0.005 |
| IGFBP2 | 0.61 | <.001 | 0.77 | 0.044 |
| IGFBP5 | 0.63 | <.001 | | |
| IGFBP6 | 0.45 | <.001 | 0.64 | <.001 |
| IL6ST | 0.55 | 0.004 | 0.63 | <.001 |
| ILK | 0.40 | <.001 | 0.57 | <.001 |
| ING5 | 0.56 | <.001 | 0.78 | 0.033 |
| ITGA1 | 0.56 | 0.004 | 0.61 | <.001 |
| ITGA3 | | | 0.78 | 0.035 |
| ITGA5 | 0.71 | 0.019 | 0.75 | 0.017 |
| ITGA7 | 0.37 | <.001 | 0.52 | <.001 |
| ITGB3 | 0.63 | 0.003 | 0.70 | 0.005 |
| ITPR1 | 0.46 | <.001 | 0.64 | <.001 |
| ITPR3 | 0.70 | 0.013 | | |

TABLE 3B-continued

Gene significantly (p < 0.05) associated with Gleason pattern for all specimens in the primary Gleason pattern or highest Gleason pattern odds ratio (OR) < 1.0 (Increased expression is negatively associated with higher Gleason score)

| Official Symbol | Primary Pattern | | Highest Pattern | |
|---|---|---|---|---|
| | OR | p-value | OR | p-value |
| ITSN1 | 0.62 | 0.001 | | |
| JUN | 0.48 | <.001 | 0.60 | <.001 |
| JUNB | 0.72 | 0.025 | | |
| KIT | 0.51 | <.001 | 0.68 | 0.007 |
| KLC1 | 0.58 | <.001 | | |
| KLK1 | 0.69 | 0.028 | 0.66 | 0.003 |
| KLK2 | 0.60 | <.001 | | |
| KLK3 | 0.63 | <.001 | 0.69 | 0.012 |
| KRT15 | 0.56 | <.001 | 0.60 | <.001 |
| KRT18 | 0.74 | 0.034 | | |
| KRT5 | 0.64 | <.001 | 0.62 | <.001 |
| LAMA4 | 0.47 | <.001 | 0.73 | 0.010 |
| LAMB3 | 0.73 | 0.018 | 0.69 | 0.003 |
| LGALS3 | 0.59 | 0.003 | 0.54 | <.001 |
| LIG3 | 0.75 | 0.044 | | |
| MAP3K7 | 0.66 | 0.003 | 0.79 | 0.031 |
| MCM3 | 0.73 | 0.013 | 0.80 | 0.034 |
| MGMT | 0.61 | 0.001 | 0.71 | 0.007 |
| MGST1 | | | 0.75 | 0.017 |
| MLXIP | 0.70 | 0.013 | | |
| MMP2 | 0.57 | <.001 | 0.72 | 0.010 |
| MMP7 | 0.69 | 0.009 | | |
| MPPED2 | 0.70 | 0.009 | 0.59 | <.001 |
| MSH6 | 0.78 | 0.046 | | |
| MTA1 | 0.69 | 0.007 | | |
| MTSS1 | 0.55 | <.001 | 0.54 | <.001 |
| MYBPC1 | 0.45 | <.001 | 0.45 | <.001 |
| NCAM1 | 0.51 | <.001 | 0.65 | <.001 |
| NCAPD3 | 0.42 | <.001 | 0.53 | <.001 |
| NCOR2 | 0.68 | 0.002 | | |
| NDUFS5 | 0.66 | 0.001 | 0.70 | 0.013 |
| NEXN | 0.48 | <.001 | 0.62 | <.001 |
| NFAT5 | 0.55 | <.001 | 0.67 | 0.001 |
| NFKBIA | | | 0.79 | 0.048 |
| NRG1 | 0.58 | 0.001 | 0.62 | 0.001 |
| OLFML3 | 0.42 | <.001 | 0.58 | <.001 |
| OMD | 0.67 | 0.004 | 0.71 | 0.004 |
| OR51E2 | 0.65 | <.001 | 0.76 | 0.007 |
| PAGE4 | 0.27 | <.001 | 0.46 | <.001 |
| PCA3 | 0.68 | 0.004 | | |
| PCDHGB7 | 0.70 | 0.025 | 0.65 | <.001 |
| PGF | 0.62 | 0.001 | | |
| PGR | 0.63 | 0.028 | | |
| PHTF2 | 0.69 | 0.033 | | |
| PLP2 | 0.54 | <.001 | 0.71 | 0.003 |
| PPAP2B | 0.41 | <.001 | 0.54 | <.001 |
| PPP1R12A | 0.48 | <.001 | 0.60 | <.001 |
| PRIMA1 | 0.62 | 0.003 | 0.65 | <.001 |
| PRKAR1B | 0.70 | 0.009 | | |
| PRKAR2B | | | 0.79 | 0.038 |
| PRKCA | 0.37 | <.001 | 0.55 | <.001 |
| PRKCB | 0.47 | <.001 | 0.56 | <.001 |
| PTCH1 | 0.70 | 0.021 | | |
| PTEN | 0.66 | 0.010 | 0.64 | <.001 |
| PTGER3 | | | 0.76 | 0.015 |
| PTGS2 | 0.70 | 0.013 | 0.68 | 0.005 |
| PTH1R | 0.48 | <.001 | | |
| PTK2B | 0.67 | 0.014 | 0.69 | 0.002 |
| PYCARD | 0.72 | 0.023 | | |
| RAB27A | | | 0.76 | 0.017 |
| RAGE | 0.77 | 0.040 | 0.57 | <.001 |
| RARB | 0.66 | 0.002 | 0.69 | 0.002 |
| RECK | 0.65 | <.001 | | |
| RHOA | 0.73 | 0.043 | | |
| RHOB | 0.61 | 0.005 | 0.62 | <.001 |
| RND3 | 0.63 | 0.006 | 0.66 | <.001 |
| SDHC | | | 0.69 | 0.002 |
| SEC23A | 0.61 | <.001 | 0.74 | 0.010 |
| SEMA3A | 0.49 | <.001 | 0.55 | <.001 |
| SERPINA3 | 0.70 | 0.034 | 0.75 | 0.020 |
| SH3RF2 | 0.33 | <.001 | 0.42 | <.001 |

TABLE 3B-continued

Gene significantly (p < 0.05) associated with Gleason pattern for all specimens in the primary Gleason pattern or highest Gleason pattern odds ratio (OR) < 1.0 (Increased expression is negatively associated with higher Gleason score)

| Official Symbol | Primary Pattern | | Highest Pattern | |
|---|---|---|---|---|
| | OR | p-value | OR | p-value |
| SLC22A3 | 0.23 | <.001 | 0.37 | <.001 |
| SMAD4 | 0.33 | <.001 | 0.39 | <.001 |
| SMARCC2 | 0.62 | 0.003 | 0.74 | 0.008 |
| SMO | 0.53 | <.001 | 0.73 | 0.009 |
| SORBS1 | 0.40 | <.001 | 0.55 | <.001 |
| SPARCL1 | 0.42 | <.001 | 0.63 | <.001 |
| SRD5A2 | 0.28 | <.001 | 0.37 | <.001 |
| ST5 | 0.52 | <.001 | 0.63 | <.001 |
| STAT5A | 0.60 | <.001 | 0.75 | 0.020 |
| STAT5B | 0.54 | <.001 | 0.65 | <.001 |
| STS | | | 0.78 | 0.035 |
| SUMO1 | 0.75 | 0.017 | 0.71 | 0.002 |
| SVIL | 0.45 | <.001 | 0.62 | <.001 |
| TARP | 0.72 | 0.017 | | |
| TGFB1I1 | 0.37 | <.001 | 0.53 | <.001 |
| TGFB2 | 0.61 | 0.025 | 0.59 | <.001 |
| TGFB3 | 0.46 | <.001 | 0.60 | <.001 |
| TIMP2 | 0.62 | 0.001 | | |
| TIMP3 | 0.55 | <.001 | 0.76 | 0.019 |
| TMPRSS2 | 0.71 | 0.014 | | |
| TNF | 0.65 | 0.010 | | |
| TNFRSF10A | 0.71 | 0.014 | 0.74 | 0.010 |
| TNFRSF10B | 0.74 | 0.030 | 0.73 | 0.016 |
| TNFSF10 | | | 0.69 | 0.004 |
| TP53 | | | 0.73 | 0.011 |
| TP63 | 0.62 | <.001 | 0.68 | 0.003 |
| TPM1 | 0.43 | <.001 | 0.47 | <.001 |
| TPM2 | 0.30 | <.001 | 0.47 | <.001 |
| TPP2 | 0.58 | <.001 | 0.69 | 0.001 |
| TRA2A | 0.71 | 0.006 | | |
| TRAF3IP2 | 0.50 | <.001 | 0.63 | <.001 |
| TRO | 0.40 | <.001 | 0.59 | <.001 |
| TRPC6 | 0.73 | 0.030 | | |
| TRPV6 | | | 0.80 | 0.047 |
| VCL | 0.44 | <.001 | 0.55 | <.001 |
| VEGFB | 0.73 | 0.029 | | |
| VIM | 0.72 | 0.013 | | |
| VTI1B | 0.78 | 0.046 | | |
| WDR19 | 0.65 | <.001 | | |
| WFDC1 | 0.50 | <.001 | 0.72 | 0.010 |
| YY1 | 0.75 | 0.045 | | |
| ZFHX3 | 0.52 | <.001 | 0.54 | <.001 |
| ZFP36 | 0.65 | 0.004 | 0.69 | 0.012 |
| ZNF827 | 0.59 | <.001 | 0.69 | 0.004 |

To identify genes associated with recurrence (cRFI, bRFI) in the primary and the highest Gleason pattern, each of 727 genes were analyzed in univariate models using specimens A1 and B2 (see Table 2, above). Tables 4A and 4B provide genes that were associated, positively or negatively, with cRFI and/or bRFI in the primary and/or highest Gleason pattern. Increased expression of genes in Table 4A is negatively associated with good prognosis, while increased expression of genes in Table 4B is positively associated with good prognosis.

TABLE 4A

Genes significantly (p < 0.05) associated with cRFI or bRFI in the primary Gleason pattern or highest Gleason pattern with hazard ratio (HR) > 1.0 (increased expression is negatively associated with good prognosis)

| Official Symbol | cRFI Primary Pattern HR | p-value | cRFI Highest Pattern HR | p-value | bRFI Primary Pattern HR | p-value | bRFI Highest Pattern HR | p-value |
|---|---|---|---|---|---|---|---|---|
| AKR1C3 | 1.304 | 0.022 | 1.312 | 0.013 | | | | |
| ANLN | 1.379 | 0.002 | 1.579 | <.001 | 1.465 | <.001 | 1.623 | <.001 |
| AQP2 | 1.184 | 0.027 | 1.276 | <.001 | | | | |
| ASAP2 | | | 1.442 | 0.006 | | | | |
| ASPN | 2.272 | <.001 | 2.106 | <.001 | 1.861 | <.001 | 1.895 | <.001 |
| ATP5E | 1.414 | 0.013 | 1.538 | <.001 | | | | |
| BAG5 | | | 1.263 | 0.044 | | | | |
| BAX | | | 1.332 | 0.026 | 1.327 | 0.012 | 1.438 | 0.002 |
| BGN | 1.947 | <.001 | 2.061 | <.001 | 1.339 | 0.017 | | |
| BIRC5 | 1.497 | <.001 | 1.567 | <.001 | 1.478 | <.001 | 1.575 | <.001 |
| BMP6 | 1.705 | <.001 | 2.016 | <.001 | 1.418 | 0.004 | 1.541 | <.001 |
| BMPR1B | 1.401 | 0.013 | | | 1.325 | 0.016 | | |
| BRCA2 | | | | | | | 1.259 | 0.007 |
| BUB1 | 1.411 | <.001 | 1.435 | <.001 | 1.352 | <.001 | 1.242 | 0.002 |
| CADPS | | | | | 1.387 | 0.009 | 1.294 | 0.027 |
| CCNB1 | | | | | 1.296 | 0.016 | 1.376 | 0.002 |
| CCNE2 | 1.468 | <.001 | 1.649 | <.001 | 1.729 | <.001 | 1.563 | <.001 |
| CD276 | 1.678 | <.001 | 1.832 | <.001 | 1.581 | <.001 | 1.385 | 0.002 |
| CDC20 | 1.547 | <.001 | 1.671 | <.001 | 1.446 | <.001 | 1.540 | <.001 |
| CDC6 | 1.400 | 0.003 | 1.290 | 0.030 | 1.403 | 0.002 | 1.276 | 0.019 |
| CDH7 | 1.403 | 0.003 | 1.413 | 0.002 | | | | |
| CDKN2B | 1.569 | <.001 | 1.752 | <.001 | 1.333 | 0.017 | 1.347 | 0.006 |
| CDKN2C | 1.612 | <.001 | 1.780 | <.001 | 1.323 | 0.005 | 1.335 | 0.004 |
| CDKN3 | 1.384 | <.001 | 1.255 | 0.024 | 1.285 | 0.003 | 1.216 | 0.028 |
| CENPF | 1.578 | <.001 | 1.692 | <.001 | 1.740 | <.001 | 1.705 | <.001 |
| CKS2 | 1.390 | 0.007 | 1.418 | 0.005 | 1.291 | 0.018 | | |
| CLTC | | | 1.368 | 0.045 | | | | |
| COL1A1 | 1.873 | <.001 | 2.103 | <.001 | 1.491 | <.001 | 1.472 | <.001 |
| COL1A2 | | | 1.462 | 0.001 | | | | |
| COL3A1 | 1.827 | <.001 | 2.005 | <.001 | 1.302 | 0.012 | 1.298 | 0.018 |
| COL4A1 | 1.490 | 0.002 | 1.613 | <.001 | | | | |
| COL8A1 | 1.692 | <.001 | 1.926 | <.001 | 1.307 | 0.013 | 1.317 | 0.010 |
| CRISP3 | 1.425 | 0.002 | 1.467 | <.001 | 1.242 | 0.045 | | |
| CTHRC1 | 1.505 | 0.002 | 2.025 | <.001 | 1.425 | 0.003 | 1.369 | 0.005 |
| CTNND2 | | | | | 1.412 | 0.003 | | |
| CXCR4 | 1.312 | 0.023 | 1.355 | 0.008 | | | | |
| DDIT4 | 1.543 | <.001 | 1.763 | <.001 | | | | |
| DYNLL1 | 1.290 | 0.039 | | | | | 1.201 | 0.004 |
| EIF3H | | | | | 1.428 | 0.012 | | |
| ENY2 | 1.361 | 0.014 | | | 1.392 | 0.008 | 1.371 | 0.001 |
| EZH2 | | | 1.311 | 0.010 | | | | |
| F2R | 1.773 | <.001 | 1.695 | <.001 | 1.495 | <.001 | 1.277 | 0.018 |
| FADD | | | 1.292 | 0.018 | | | | |
| FAM171B | | | 1.285 | 0.036 | | | | |
| FAP | 1.455 | 0.004 | 1.560 | 0.001 | 1.298 | 0.022 | 1.274 | 0.038 |
| FASN | 1.263 | 0.035 | | | | | | |
| FCGR3A | | | 1.654 | <.001 | 1.253 | 0.033 | 1.350 | 0.007 |
| FGF5 | 1.219 | 0.030 | | | | | | |
| GNPTAB | 1.388 | 0.007 | 1.503 | 0.003 | 1.355 | 0.005 | 1.434 | 0.002 |
| GPR68 | | | 1.361 | 0.008 | | | | |
| GREM1 | 1.470 | 0.003 | 1.716 | <.001 | 1.421 | 0.003 | 1.316 | 0.017 |
| HDAC1 | | | | | 1.290 | 0.025 | | |
| HDAC9 | | | 1.395 | 0.012 | | | | |
| HRAS | 1.424 | 0.006 | 1.447 | 0.020 | | | | |
| HSD17B4 | 1.342 | 0.019 | 1.282 | 0.026 | 1.569 | <.001 | 1.390 | 0.002 |
| HSPA8 | 1.290 | 0.034 | | | | | | |
| IGFBP3 | 1.333 | 0.022 | 1.442 | 0.003 | 1.253 | 0.040 | 1.323 | 0.005 |
| INHBA | 2.368 | <.001 | 2.765 | <.001 | 1.466 | 0.002 | 1.671 | <.001 |
| JAG1 | 1.359 | 0.006 | 1.367 | 0.005 | 1.259 | 0.024 | | |
| KCNN2 | 1.361 | 0.011 | 1.413 | 0.005 | 1.312 | 0.017 | 1.281 | 0.030 |
| KHDRBS3 | 1.387 | 0.006 | 1.601 | <.001 | 1.573 | <.001 | 1.353 | 0.006 |
| KIAA0196 | | | | | | | 1.249 | 0.037 |
| KIF4A | 1.212 | 0.016 | | | 1.149 | 0.040 | 1.278 | 0.003 |
| KLK14 | 1.167 | 0.023 | | | | | 1.180 | 0.007 |
| KPNA2 | | | 1.425 | 0.009 | 1.353 | 0.005 | 1.305 | 0.019 |
| KRT75 | | | | | | | 1.164 | 0.028 |
| LAMA3 | | | | | 1.327 | 0.011 | | |
| LAMB1 | | | 1.347 | 0.019 | | | | |
| LAMC1 | 1.555 | 0.001 | 1.310 | 0.030 | | | 1.349 | 0.014 |
| LIMS1 | | | | | | | 1.275 | 0.022 |
| LOX | | | | | 1.358 | 0.003 | 1.410 | <.001 |

TABLE 4A-continued

Genes significantly (p < 0.05) associated with cRFI or bRFI in the primary Gleason pattern or highest Gleason pattern with hazard ratio (HR) > 1.0 (increased expression is negatively associated with good prognosis)

| Official Symbol | cRFI Primary Pattern | | cRFI Highest Pattern | | bRFI Primary Pattern | | bRFI Highest Pattern | |
|---|---|---|---|---|---|---|---|---|
| | HR | p-value | HR | p-value | HR | p-value | HR | p-value |
| LTBP2 | 1.396 | 0.009 | 1.656 | <.001 | 1.278 | 0.022 | | |
| LUM | | | 1.315 | 0.021 | | | | |
| MANF | | | | | 1.660 | <.001 | 1.323 | 0.011 |
| MCM2 | | | | | 1.345 | 0.011 | 1.387 | 0.014 |
| MCM6 | 1.307 | 0.023 | 1.352 | 0.008 | | | 1.244 | 0.039 |
| MELK | 1.293 | 0.014 | 1.401 | <.001 | 1.501 | <.001 | 1.256 | 0.012 |
| MMP11 | 1.680 | <.001 | 1.474 | <.001 | 1.489 | <.001 | 1.257 | 0.030 |
| MRPL13 | | | | | | | 1.260 | 0.025 |
| MSH2 | | | 1.295 | 0.027 | | | | |
| MYBL2 | 1.664 | <.001 | 1.670 | <.001 | 1.399 | <.001 | 1.431 | <.001 |
| MYO6 | | | 1.301 | 0.033 | | | | |
| NETO2 | 1.412 | 0.004 | 1.302 | 0.027 | 1.298 | 0.009 | | |
| NFKB1 | | | | | 1.236 | 0.050 | | |
| NOX4 | 1.492 | <.001 | 1.507 | 0.001 | 1.555 | <.001 | 1.262 | 0.019 |
| NPM1 | | | | | 1.287 | 0.036 | | |
| NRIP3 | | | 1.219 | 0.031 | | | 1.218 | 0.018 |
| NRP1 | | | 1.482 | 0.002 | | | 1.245 | 0.041 |
| OLFML2B | | | 1.362 | 0.015 | | | | |
| OR51E1 | | | | | 1.531 | <.001 | 1.488 | 0.003 |
| PAK6 | | | 1.269 | 0.033 | | | | |
| PATE1 | 1.308 | <.001 | 1.332 | <.001 | 1.164 | 0.044 | | |
| PCNA | | | | | | | 1.278 | 0.020 |
| PEX10 | 1.436 | 0.005 | 1.393 | 0.009 | | | | |
| PGD | 1.298 | 0.048 | | | 1.579 | <.001 | | |
| PGK1 | | | 1.274 | 0.023 | | | 1.262 | 0.009 |
| PLA2G7 | | | | | 1.315 | 0.011 | 1.346 | 0.005 |
| PLAU | | | | | 1.319 | 0.010 | | |
| PLK1 | 1.309 | 0.021 | 1.563 | <.001 | 1.410 | 0.002 | 1.372 | 0.003 |
| PLOD2 | | | 1.284 | 0.019 | 1.272 | 0.014 | 1.332 | 0.005 |
| POSTN | 1.599 | <.001 | 1.514 | 0.002 | 1.391 | 0.005 | | |
| PPP3CA | | | | | 1.402 | 0.007 | 1.316 | 0.018 |
| PSMD13 | 1.278 | 0.040 | 1.297 | 0.033 | 1.279 | 0.017 | 1.373 | 0.004 |
| PTK6 | 1.640 | <.001 | 1.932 | <.001 | 1.369 | 0.001 | 1.406 | <.001 |
| PTTG1 | 1.409 | <.001 | 1.510 | <.001 | 1.347 | 0.001 | 1.558 | <.001 |
| RAD21 | 1.315 | 0.035 | 1.402 | 0.004 | 1.589 | <.001 | 1.439 | <.001 |
| RAF1 | | | | | 1.503 | 0.002 | | |
| RALA | 1.521 | 0.004 | 1.403 | 0.007 | 1.563 | <.001 | 1.229 | 0.040 |
| RALBP1 | | | | | 1.277 | 0.033 | | |
| RGS7 | 1.154 | 0.015 | 1.266 | 0.010 | | | | |
| RRM1 | 1.570 | 0.001 | 1.602 | <.001 | | | | |
| RRM2 | 1.368 | <.001 | 1.289 | 0.004 | 1.396 | <.001 | 1.230 | 0.015 |
| SAT1 | 1.482 | 0.016 | 1.403 | 0.030 | | | | |
| SDC1 | | | | | 1.340 | 0.018 | 1.396 | 0.018 |
| SEC14L1 | | | 1.260 | 0.048 | | | 1.360 | 0.002 |
| SESN3 | 1.485 | <.001 | 1.631 | <.001 | 1.232 | 0.047 | 1.292 | 0.014 |
| SFRP4 | 1.800 | <.001 | 1.814 | <.001 | 1.496 | <.001 | 1.289 | 0.027 |
| SHMT2 | 1.807 | <.001 | 1.658 | <.001 | 1.673 | <.001 | 1.548 | <.001 |
| SKIL | | | | | 1.327 | 0.008 | | |
| SLC25A21 | | | | | 1.398 | 0.001 | 1.285 | 0.018 |
| SOX4 | | | | | 1.286 | 0.020 | 1.280 | 0.030 |
| SPARC | 1.539 | <.001 | 1.842 | <.001 | | | 1.269 | 0.026 |
| SPP1 | | | 1.322 | 0.022 | | | | |
| SQLE | | | 1.359 | 0.020 | 1.270 | 0.036 | | |
| STMN1 | 1.402 | 0.007 | 1.446 | 0.005 | 1.279 | 0.031 | | |
| SULF1 | | | 1.587 | <.001 | | | | |
| TAF2 | | | | | | | 1.273 | 0.027 |
| TFDP1 | | | 1.328 | 0.021 | 1.400 | 0.005 | 1.416 | 0.001 |
| THBS2 | 1.812 | <.001 | 1.960 | <.001 | 1.320 | 0.012 | 1.256 | 0.038 |
| THY1 | 1.362 | 0.020 | 1.662 | <.001 | | | | |
| TK1 | | | 1.251 | 0.011 | 1.377 | <.001 | 1.401 | <.001 |
| TOP2A | 1.670 | <.001 | 1.920 | <.001 | 1.869 | <.001 | 1.927 | <.001 |
| TPD52 | 1.324 | 0.011 | | | 1.366 | 0.002 | 1.351 | 0.005 |
| TPX2 | 1.884 | <.001 | 2.154 | <.001 | 1.874 | <.001 | 1.794 | <.001 |
| UAP1 | | | | | 1.244 | 0.044 | | |
| UBE2C | 1.403 | <.001 | 1.541 | <.001 | 1.306 | 0.002 | 1.323 | <.001 |
| UBE2T | 1.667 | <.001 | 1.282 | 0.023 | 1.502 | <.001 | 1.298 | 0.005 |
| UGT2B15 | | | 1.295 | 0.001 | | | 1.275 | 0.002 |
| UGT2B17 | | | | | | | 1.294 | 0.025 |
| UHRF1 | 1.454 | <.001 | 1.531 | <.001 | 1.257 | 0.029 | | |
| VCPIP1 | 1.390 | 0.009 | 1.414 | 0.004 | 1.294 | 0.021 | 1.283 | 0.021 |
| WNT5A | | | 1.274 | 0.038 | 1.298 | 0.020 | | |

TABLE 4A-continued

Genes significantly (p < 0.05) associated with cRFI or bRFI in the primary Gleason pattern or highest Gleason pattern with hazard ratio (HR) > 1.0 (increased expression is negatively associated with good prognosis)

| Official Symbol | cRFI Primary Pattern HR | cRFI Primary Pattern p-value | cRFI Highest Pattern HR | cRFI Highest Pattern p-value | bRFI Primary Pattern HR | bRFI Primary Pattern p-value | bRFI Highest Pattern HR | bRFI Highest Pattern p-value |
|---|---|---|---|---|---|---|---|---|
| XIAP |  |  |  |  | 1.464 | 0.006 |  |  |
| ZMYND8 |  |  | 1.277 | 0.048 |  |  |  |  |
| ZWINT | 1.259 | 0.047 |  |  |  |  |  |  |

TABLE 4B

Genes significantly (p < 0.05) associated with cRFI or bRFI in the primary Gleason pattern or highest Gleason pattern with hazard ratio (HR) <1.0 (increased expression is positively associated with good prognosis)

| Official Symbol | cRFI Primary Pattern HR | cRFI Primary Pattern p-value | cRFI Highest Pattern HR | cRFI Highest Pattern p-value | bRFI Primary Pattern HR | bRFI Primary Pattern p-value | bRFI Highest Pattern HR | bRFI Highest Pattern p-value |
|---|---|---|---|---|---|---|---|---|
| AAMP | 0.564 | <.001 | 0.571 | <.001 | 0.764 | 0.037 | 0.786 | 0.034 |
| ABCA5 | 0.755 | <.001 | 0.695 | <.001 |  |  | 0.800 | 0.006 |
| ABCB1 | 0.777 | 0.026 |  |  |  |  |  |  |
| ABCG2 | 0.788 | 0.033 | 0.784 | 0.040 | 0.803 | 0.018 | 0.750 | 0.004 |
| ABHD2 |  |  | 0.734 | 0.011 |  |  |  |  |
| ACE |  |  | 0.782 | 0.048 |  |  |  |  |
| ACOX2 | 0.639 | <.001 | 0.631 | <.001 | 0.713 | <.001 | 0.716 | 0.002 |
| ADH5 | 0.625 | <.001 | 0.637 | <.001 | 0.753 | 0.026 |  |  |
| AKAP1 | 0.764 | 0.006 | 0.800 | 0.005 | 0.837 | 0.046 |  |  |
| AKR1C1 | 0.773 | 0.033 |  |  | 0.802 | 0.032 |  |  |
| AKT1 |  |  | 0.714 | 0.005 |  |  |  |  |
| AKT3 | 0.811 | 0.015 | 0.809 | 0.021 |  |  |  |  |
| ALDH1A2 | 0.606 | <.001 | 0.498 | <.001 | 0.613 | <.001 | 0.624 | <.001 |
| AMPD3 |  |  |  |  | 0.793 | 0.024 |  |  |
| ANPEP | 0.584 | <.001 | 0.493 | <.001 |  |  |  |  |
| ANXA2 | 0.753 | 0.013 | 0.781 | 0.036 | 0.762 | 0.008 | 0.795 | 0.032 |
| APRT |  |  | 0.758 | 0.026 | 0.780 | 0.044 | 0.746 | 0.008 |
| ATXN1 | 0.673 | 0.001 | 0.776 | 0.029 | 0.809 | 0.031 | 0.812 | 0.043 |
| AXIN2 | 0.674 | <.001 | 0.571 | <.001 | 0.776 | 0.005 | 0.757 | 0.005 |
| AZGP1 | 0.585 | <.001 | 0.652 | <.001 | 0.664 | <.001 | 0.746 | <.001 |
| BAD |  |  | 0.765 | 0.023 |  |  |  |  |
| BCL2 | 0.788 | 0.033 | 0.778 | 0.036 |  |  |  |  |
| BDKRB1 | 0.728 | 0.039 |  |  |  |  |  |  |
| BIK |  |  | 0.712 | 0.005 |  |  |  |  |
| BIN1 | 0.607 | <.001 | 0.724 | 0.002 | 0.726 | <.001 | 0.834 | 0.034 |
| BTG3 |  |  |  |  | 0.847 | 0.034 |  |  |
| BTRC | 0.688 | 0.001 | 0.713 | 0.003 |  |  |  |  |
| C7 | 0.589 | <.001 | 0.639 | <.001 | 0.629 | <.001 | 0.691 | <.001 |
| CADM1 | 0.546 | <.001 | 0.529 | <.001 | 0.743 | 0.008 | 0.769 | 0.015 |
| CASP1 | 0.769 | 0.014 | 0.799 | 0.028 | 0.799 | 0.010 | 0.815 | 0.018 |
| CAV1 | 0.736 | 0.011 | 0.711 | 0.005 | 0.675 | <.001 | 0.743 | 0.006 |
| CAV2 |  |  | 0.636 | 0.010 | 0.648 | 0.012 | 0.685 | 0.012 |
| CCL2 | 0.759 | 0.029 | 0.764 | 0.024 |  |  |  |  |
| CCNH | 0.689 | <.001 | 0.700 | <.001 |  |  |  |  |
| CD164 | 0.664 | <.001 | 0.651 | <.001 |  |  |  |  |
| CD1A |  |  |  |  | 0.687 | 0.004 |  |  |
| CD44 | 0.545 | <.001 | 0.600 | <.001 | 0.788 | 0.018 | 0.799 | 0.023 |
| CD82 | 0.771 | 0.009 | 0.748 | 0.004 |  |  |  |  |
| CDC25B | 0.755 | 0.006 |  |  | 0.817 | 0.025 |  |  |
| CDK14 | 0.845 | 0.043 |  |  |  |  |  |  |
| CDK2 |  |  |  |  |  |  | 0.819 | 0.032 |
| CDK3 | 0.733 | 0.005 |  |  | 0.772 | 0.006 | 0.838 | 0.017 |
| CDKN1A |  |  | 0.766 | 0.041 |  |  |  |  |
| CDKN1C | 0.662 | <.001 | 0.712 | 0.002 | 0.693 | <.001 | 0.761 | 0.009 |
| CHN1 | 0.788 | 0.036 |  |  |  |  |  |  |
| COL6A1 | 0.608 | <.001 | 0.767 | 0.013 | 0.706 | <.001 | 0.775 | 0.007 |
| CSF1 | 0.626 | <.001 | 0.709 | 0.003 |  |  |  |  |
| CSK |  |  |  |  | 0.837 | 0.029 |  |  |
| CSRP1 | 0.793 | 0.024 | 0.782 | 0.019 |  |  |  |  |
| CTNNB1 | 0.898 | 0.042 |  |  | 0.885 | <.001 |  |  |
| CTSB | 0.701 | 0.004 | 0.713 | 0.007 | 0.715 | 0.002 | 0.803 | 0.038 |
| CTSK |  |  |  |  | 0.815 | 0.042 |  |  |
| CXCL12 | 0.652 | <.001 | 0.802 | 0.044 | 0.711 | 0.001 |  |  |

TABLE 4B-continued

Genes significantly (p < 0.05) associated with cRFI or bRFI in the primary Gleason pattern or highest Gleason pattern with hazard ratio (HR) <1.0 (increased expression is positively associated with good prognosis)

| Official Symbol | cRFI Primary Pattern | | cRFI Highest Pattern | | bRFI Primary Pattern | | bRFI Highest Pattern | |
|---|---|---|---|---|---|---|---|---|
| | HR | p-value | HR | p-value | HR | p-value | HR | p-value |
| CYP3A5 | 0.463 | <.001 | 0.436 | <.001 | 0.727 | 0.003 | | |
| CYR61 | 0.652 | 0.002 | 0.676 | 0.002 | | | | |
| DAP | | | 0.761 | 0.026 | 0.775 | 0.025 | 0.802 | 0.048 |
| DARC | | | | | 0.725 | 0.005 | 0.792 | 0.032 |
| DDR2 | | | | | 0.719 | 0.001 | 0.763 | 0.008 |
| DES | 0.619 | <.001 | 0.737 | 0.005 | 0.638 | <.001 | 0.793 | 0.017 |
| DHRS9 | 0.642 | 0.003 | | | | | | |
| DHX9 | 0.888 | <.001 | | | | | | |
| DLC1 | 0.710 | 0.007 | 0.715 | 0.009 | | | | |
| DLGAP1 | 0.613 | <.001 | 0.551 | <.001 | | | 0.779 | 0.049 |
| DNM3 | 0.679 | <.001 | | | 0.812 | 0.037 | | |
| DPP4 | 0.591 | <.001 | 0.613 | <.001 | 0.761 | 0.003 | | |
| DPT | 0.613 | <.001 | 0.576 | <.001 | 0.647 | <.001 | 0.677 | <.001 |
| DUSP1 | 0.662 | 0.001 | 0.665 | 0.001 | | | 0.785 | 0.024 |
| DUSP6 | 0.713 | 0.005 | 0.668 | 0.002 | | | | |
| EDNRA | 0.702 | 0.002 | 0.779 | 0.036 | | | | |
| EGF | | | 0.738 | 0.028 | | | | |
| EGR1 | 0.569 | <.001 | 0.577 | <.001 | | | 0.782 | 0.022 |
| EGR3 | 0.601 | <.001 | 0.619 | <.001 | | | 0.800 | 0.038 |
| EIF2S3 | | | | | | | 0.756 | 0.015 |
| EIF5 | 0.776 | 0.023 | 0.787 | 0.028 | | | | |
| ELK4 | 0.628 | <.001 | 0.658 | <.001 | | | | |
| EPHA2 | 0.720 | 0.011 | 0.663 | 0.004 | | | | |
| EPHA3 | 0.727 | 0.003 | | | 0.772 | 0.005 | | |
| ERBB2 | 0.786 | 0.019 | 0.738 | 0.003 | 0.815 | 0.041 | | |
| ERBB3 | 0.728 | 0.002 | 0.711 | 0.002 | 0.828 | 0.043 | 0.813 | 0.023 |
| ERCC1 | 0.771 | 0.023 | 0.725 | 0.007 | 0.806 | 0.049 | 0.704 | 0.002 |
| EREG | | | | | 0.754 | 0.016 | 0.777 | 0.034 |
| ESR2 | | | 0.731 | 0.026 | | | | |
| FAAH | 0.708 | 0.004 | 0.758 | 0.012 | 0.784 | 0.031 | 0.774 | 0.007 |
| FAM107A | 0.517 | <.001 | 0.576 | <.001 | 0.642 | <.001 | 0.656 | <.001 |
| FAM13C | 0.568 | <.001 | 0.526 | <.001 | 0.739 | 0.002 | 0.639 | <.001 |
| FAS | 0.755 | 0.014 | | | | | | |
| FASLG | | | 0.706 | 0.021 | | | | |
| FGF10 | 0.653 | <.001 | | | 0.685 | <.001 | 0.766 | 0.022 |
| FGF17 | | | 0.746 | 0.023 | 0.781 | 0.015 | 0.805 | 0.028 |
| FGF7 | 0.794 | 0.030 | | | 0.820 | 0.037 | 0.811 | 0.040 |
| FGFR2 | 0.683 | <.001 | 0.686 | <.001 | 0.674 | <.001 | 0.703 | <.001 |
| FKBP5 | | | 0.676 | 0.001 | | | | |
| FLNA | 0.653 | <.001 | 0.741 | 0.010 | 0.682 | <.001 | 0.771 | 0.016 |
| FLNC | 0.751 | 0.029 | 0.779 | 0.047 | 0.663 | <.001 | 0.725 | <.001 |
| FLT1 | | | 0.799 | 0.044 | | | | |
| FOS | 0.566 | <.001 | 0.543 | <.001 | | | 0.757 | 0.006 |
| FOXO1 | | | | | 0.816 | 0.039 | 0.798 | 0.023 |
| FOXQ1 | 0.753 | 0.017 | 0.757 | 0.024 | 0.804 | 0.018 | | |
| FYN | 0.779 | 0.031 | | | | | | |
| GADD45B | 0.590 | <.001 | 0.619 | <.001 | | | | |
| GDF15 | 0.759 | 0.019 | 0.794 | 0.048 | | | | |
| GHR | 0.702 | 0.005 | 0.630 | <.001 | 0.673 | <.001 | 0.590 | <.001 |
| GNRH1 | | | | | 0.742 | 0.014 | | |
| GPM6B | 0.653 | <.001 | 0.633 | <.001 | 0.696 | <.001 | 0.768 | 0.007 |
| GSN | 0.570 | <.001 | 0.697 | 0.001 | 0.697 | <.001 | 0.758 | 0.005 |
| GSTM1 | 0.612 | <.001 | 0.588 | <.001 | 0.718 | <.001 | 0.801 | 0.020 |
| GSTM2 | 0.540 | <.001 | 0.630 | <.001 | 0.602 | <.001 | 0.706 | <.001 |
| HGD | 0.796 | 0.020 | 0.736 | 0.002 | | | | |
| HIRIP3 | 0.753 | 0.011 | | | 0.824 | 0.050 | | |
| HK1 | 0.684 | <.001 | 0.683 | <.001 | 0.799 | 0.011 | 0.804 | 0.014 |
| HLA-G | | | 0.726 | 0.022 | | | | |
| HLF | 0.555 | <.001 | 0.582 | <.001 | 0.703 | <.001 | 0.702 | <.001 |
| HNF1B | 0.690 | <.001 | 0.585 | <.001 | | | | |
| HPS1 | 0.744 | 0.003 | 0.784 | 0.020 | 0.836 | 0.047 | | |
| HSD3B2 | | | | | | | 0.733 | 0.016 |
| HSP90AB1 | 0.801 | 0.036 | | | | | | |
| HSPA5 | | | 0.776 | 0.034 | | | | |
| HSPB1 | 0.813 | 0.020 | | | | | | |
| HSPB2 | 0.762 | 0.037 | | | 0.699 | 0.002 | 0.783 | 0.034 |
| HSPG2 | | | | | 0.794 | 0.044 | | |
| ICAM1 | 0.743 | 0.024 | 0.768 | 0.040 | | | | |
| IER3 | 0.686 | 0.002 | 0.663 | <.001 | | | | |
| IFIT1 | 0.649 | <.001 | 0.761 | 0.026 | | | | |
| IGF1 | 0.634 | <.001 | 0.537 | <.001 | 0.696 | <.001 | 0.688 | <.001 |

TABLE 4B-continued

Genes significantly (p < 0.05) associated with cRFI or bRFI in the primary Gleason pattern or highest Gleason pattern with hazard ratio (HR) <1.0 (increased expression is positively associated with good prognosis)

| Official Symbol | cRFI Primary Pattern | | cRFI Highest Pattern | | bRFI Primary Pattern | | bRFI Highest Pattern | |
|---|---|---|---|---|---|---|---|---|
| | HR | p-value | HR | p-value | HR | p-value | HR | p-value |
| IGF2 | | | | | 0.732 | 0.004 | | |
| IGFBP2 | 0.548 | <.001 | 0.620 | <.001 | | | | |
| IGFBP5 | 0.681 | <.001 | | | | | | |
| IGFBP6 | 0.577 | <.001 | | | 0.675 | <.001 | | |
| IL1B | 0.712 | 0.005 | 0.742 | 0.009 | | | | |
| IL6 | 0.763 | 0.028 | | | | | | |
| IL6R | | | 0.791 | 0.039 | | | | |
| IL6ST | 0.585 | <.001 | 0.639 | <.001 | 0.730 | 0.002 | 0.768 | 0.006 |
| IL8 | 0.624 | <.001 | 0.662 | 0.001 | | | | |
| ILK | 0.712 | 0.009 | 0.728 | 0.012 | 0.790 | 0.047 | 0.790 | 0.042 |
| ING5 | 0.625 | <.001 | 0.658 | <.001 | 0.728 | 0.002 | | |
| ITGA5 | 0.728 | 0.006 | 0.803 | 0.039 | | | | |
| ITGA6 | 0.779 | 0.007 | 0.775 | 0.006 | | | | |
| ITGA7 | 0.584 | <.001 | 0.700 | 0.001 | 0.656 | <.001 | 0.786 | 0.014 |
| ITGAD | | | 0.657 | 0.020 | | | | |
| ITGB4 | 0.718 | 0.007 | 0.689 | <.001 | 0.818 | 0.041 | | |
| ITGB5 | | | 0.801 | 0.050 | | | | |
| ITPR1 | 0.707 | 0.001 | | | | | | |
| JUN | 0.556 | <.001 | 0.574 | <.001 | | | 0.754 | 0.008 |
| JUNB | 0.730 | 0.017 | 0.715 | 0.010 | | | | |
| KIT | 0.644 | 0.004 | 0.705 | 0.019 | 0.605 | <.001 | 0.659 | 0.001 |
| KLC1 | 0.692 | 0.003 | 0.774 | 0.024 | 0.747 | 0.008 | | |
| KLF6 | 0.770 | 0.032 | 0.776 | 0.039 | | | | |
| KLK1 | 0.646 | <.001 | 0.652 | 0.001 | 0.784 | 0.037 | | |
| KLK10 | | | 0.716 | 0.006 | | | | |
| KLK2 | 0.647 | <.001 | 0.628 | <.001 | | | 0.786 | 0.009 |
| KLK3 | 0.706 | <.001 | 0.748 | <.001 | | | 0.845 | 0.018 |
| KRT1 | | | | | | | 0.734 | 0.024 |
| KRT15 | 0.627 | <.001 | 0.526 | <.001 | 0.704 | <.001 | 0.782 | 0.029 |
| KRT18 | 0.624 | <.001 | 0.617 | <.001 | 0.738 | 0.005 | 0.760 | 0.005 |
| KRT5 | 0.640 | <.001 | 0.550 | <.001 | 0.740 | <.001 | 0.798 | 0.023 |
| KRT8 | 0.716 | 0.006 | 0.744 | 0.008 | | | | |
| L1CAM | 0.738 | 0.021 | 0.692 | 0.009 | | | 0.761 | 0.036 |
| LAG3 | 0.741 | 0.013 | 0.729 | 0.011 | | | | |
| LAMA4 | 0.686 | 0.011 | | | 0.592 | 0.003 | | |
| LAMA5 | | | | | | | 0.786 | 0.025 |
| LAMB3 | 0.661 | <.001 | 0.617 | <.001 | 0.734 | <.001 | | |
| LGALS3 | 0.618 | <.001 | 0.702 | 0.001 | 0.734 | 0.001 | 0.793 | 0.012 |
| LIG3 | 0.705 | 0.008 | 0.615 | <.001 | | | | |
| LRP1 | 0.786 | 0.050 | | | 0.795 | 0.023 | 0.770 | 0.009 |
| MAP3K7 | | | | | 0.789 | 0.003 | | |
| MGMT | 0.632 | <.001 | 0.693 | <.001 | | | | |
| MICA | 0.781 | 0.014 | 0.653 | <.001 | | | 0.833 | 0.043 |
| MPPED2 | 0.655 | <.001 | 0.597 | <.001 | 0.719 | <.001 | 0.759 | 0.006 |
| MSH6 | | | | | 0.793 | 0.015 | | |
| MTSS1 | 0.613 | <.001 | | | 0.746 | 0.008 | | |
| MVP | 0.792 | 0.028 | 0.795 | 0.045 | 0.819 | 0.023 | | |
| MYBPC1 | 0.648 | <.001 | 0.496 | <.001 | 0.701 | <.001 | 0.629 | <.001 |
| NCAM1 | | | | | 0.773 | 0.015 | | |
| NCAPD3 | 0.574 | <.001 | 0.463 | <.001 | 0.679 | <.001 | 0.640 | <.001 |
| NEXN | 0.701 | 0.002 | 0.791 | 0.035 | 0.725 | 0.002 | 0.781 | 0.016 |
| NFAT5 | 0.515 | <.001 | 0.586 | <.001 | 0.785 | 0.017 | | |
| NFATC2 | 0.753 | 0.023 | | | | | | |
| NFKBIA | 0.778 | 0.037 | | | | | | |
| NRG1 | 0.644 | 0.004 | 0.696 | 0.017 | 0.698 | 0.012 | | |
| OAZ1 | 0.777 | 0.034 | 0.775 | 0.022 | | | | |
| OLFML3 | 0.621 | <.001 | 0.720 | 0.001 | 0.600 | <.001 | 0.626 | <.001 |
| OMD | 0.706 | 0.003 | | | | | | |
| OR51E2 | 0.820 | 0.037 | 0.798 | 0.027 | | | | |
| PAGE4 | 0.549 | <.001 | 0.613 | <.001 | 0.542 | <.001 | 0.628 | <.001 |
| PCA3 | 0.684 | <.001 | 0.635 | <.001 | | | | |
| PCDHGB7 | 0.790 | 0.045 | | | 0.725 | 0.002 | 0.664 | <.001 |
| PGF | 0.753 | 0.017 | | | | | | |
| PGR | 0.740 | 0.021 | 0.728 | 0.018 | | | | |
| PIK3CG | 0.803 | 0.024 | | | | | | |
| PLAUR | 0.778 | 0.035 | | | | | | |
| PLG | | | | | | | 0.728 | 0.028 |
| PPAP2B | 0.575 | <.001 | 0.629 | <.001 | 0.643 | <.001 | 0.699 | <.001 |
| PPP1R12A | 0.647 | <.001 | 0.683 | 0.002 | 0.782 | 0.023 | 0.784 | 0.030 |
| PRIMA1 | 0.626 | <.001 | 0.658 | <.001 | 0.703 | 0.002 | 0.724 | 0.003 |
| PRKCA | 0.642 | <.001 | 0.799 | 0.029 | 0.677 | 0.001 | 0.776 | 0.006 |

TABLE 4B-continued

Genes significantly (p < 0.05) associated with cRFI or bRFI in the primary Gleason pattern or highest Gleason pattern with hazard ratio (HR) <1.0 (increased expression is positively associated with good prognosis)

| Official Symbol | cRFI Primary Pattern | | cRFI Highest Pattern | | bRFI Primary Pattern | | bRFI Highest Pattern | |
|---|---|---|---|---|---|---|---|---|
| | HR | p-value | HR | p-value | HR | p-value | HR | p-value |
| PRKCB | 0.675 | 0.001 | | | 0.648 | <.001 | 0.747 | 0.006 |
| PROM1 | 0.603 | 0.018 | | | 0.659 | 0.014 | 0.493 | 0.008 |
| PTCH1 | 0.680 | 0.001 | | | 0.753 | 0.010 | 0.789 | 0.018 |
| PTEN | 0.732 | 0.002 | 0.747 | 0.005 | 0.744 | <.001 | 0.765 | 0.002 |
| PTGS2 | 0.596 | <.001 | 0.610 | <.001 | | | | |
| PTH1R | 0.767 | 0.042 | | | 0.775 | 0.028 | 0.788 | 0.047 |
| PTHLH | 0.617 | 0.002 | 0.726 | 0.025 | 0.668 | 0.002 | 0.718 | 0.007 |
| PTK2B | 0.744 | 0.003 | 0.679 | <.001 | 0.766 | 0.002 | 0.726 | <.001 |
| PTPN1 | 0.760 | 0.020 | 0.780 | 0.042 | | | | |
| PYCARD | | | 0.748 | 0.012 | | | | |
| RAB27A | | | 0.708 | 0.004 | | | | |
| RAB30 | 0.755 | 0.008 | | | | | | |
| RAGE | | | 0.817 | 0.048 | | | | |
| RAP1B | | | | | 0.818 | 0.050 | | |
| RARB | 0.757 | 0.007 | 0.677 | <.001 | 0.789 | 0.007 | 0.746 | 0.003 |
| RASSF1 | 0.816 | 0.035 | | | | | | |
| RHOB | 0.725 | 0.009 | 0.676 | 0.001 | | | 0.793 | 0.039 |
| RLN1 | | | 0.742 | 0.033 | | | 0.762 | 0.040 |
| RND3 | 0.636 | <.001 | 0.647 | <.001 | | | | |
| RNF114 | | | 0.749 | 0.011 | | | | |
| SDC2 | | | | | 0.721 | 0.004 | | |
| SDHC | 0.725 | 0.003 | 0.727 | 0.006 | | | | |
| SEMA3A | 0.757 | 0.024 | 0.721 | 0.010 | | | | |
| SERPINA3 | 0.716 | 0.008 | 0.660 | 0.001 | | | | |
| SERPINB5 | 0.747 | 0.031 | 0.616 | 0.002 | | | | |
| SH3RF2 | 0.577 | <.001 | 0.458 | <.001 | 0.702 | <.001 | 0.640 | <.001 |
| SLC22A3 | 0.565 | <.001 | 0.540 | <.001 | 0.747 | 0.004 | 0.756 | 0.007 |
| SMAD4 | 0.546 | <.001 | 0.573 | <.001 | 0.636 | <.001 | 0.627 | <.001 |
| SMARCD1 | 0.718 | <.001 | 0.775 | 0.017 | | | | |
| SMO | 0.793 | 0.029 | 0.754 | 0.021 | | | 0.718 | 0.003 |
| SOD1 | 0.757 | 0.049 | 0.707 | 0.006 | | | | |
| SORBS1 | 0.645 | <.001 | 0.716 | 0.003 | 0.693 | <.001 | 0.784 | 0.025 |
| SPARCL1 | 0.821 | 0.028 | | | 0.829 | 0.014 | 0.781 | 0.030 |
| SPDEF | 0.778 | <.001 | | | | | | |
| SPINT1 | 0.732 | 0.009 | 0.842 | 0.026 | | | | |
| SRC | 0.647 | <.001 | 0.632 | <.001 | | | | |
| SRD5A1 | | | | | 0.813 | 0.040 | | |
| SRD5A2 | 0.489 | <.001 | 0.533 | <.001 | 0.544 | <.001 | 0.611 | <.001 |
| ST5 | 0.713 | 0.002 | 0.783 | 0.011 | 0.725 | <.001 | 0.827 | 0.025 |
| STAT3 | 0.773 | 0.037 | 0.759 | 0.035 | | | | |
| STAT5A | 0.695 | <.001 | 0.719 | 0.002 | 0.806 | 0.020 | 0.783 | 0.008 |
| STAT5B | 0.633 | <.001 | 0.655 | <.001 | | | 0.814 | 0.028 |
| SUMO1 | 0.790 | 0.015 | | | | | | |
| SVIL | 0.659 | <.001 | 0.713 | 0.002 | 0.711 | 0.002 | 0.779 | 0.010 |
| TARP | | | | | | | 0.800 | 0.040 |
| TBP | 0.761 | 0.010 | | | | | | |
| TFF3 | 0.734 | 0.010 | 0.659 | <.001 | | | | |
| TGFB1I1 | 0.618 | <.001 | 0.693 | 0.002 | 0.637 | <.001 | 0.719 | 0.004 |
| TGFB2 | 0.679 | <.001 | 0.747 | 0.005 | 0.805 | 0.030 | | |
| TGFB3 | | | | | 0.791 | 0.037 | | |
| TGFBR2 | | | | | 0.778 | 0.035 | | |
| TIMP3 | | | | | 0.751 | 0.011 | | |
| TMPRSS2 | 0.745 | 0.003 | 0.708 | <.001 | | | | |
| TNF | | | 0.670 | 0.013 | | | 0.697 | 0.015 |
| TNFRSF10A | 0.780 | 0.018 | 0.752 | 0.006 | 0.817 | 0.032 | | |
| TNFRSF10B | 0.576 | <.001 | 0.655 | <.001 | 0.766 | 0.004 | 0.778 | 0.002 |
| TNFRSF18 | 0.648 | 0.016 | | | 0.759 | 0.034 | | |
| TNFSF10 | 0.653 | <.001 | 0.667 | 0.004 | | | | |
| TP53 | | | 0.729 | 0.003 | | | | |
| TP63 | 0.759 | 0.016 | 0.636 | <.001 | 0.698 | <.001 | 0.712 | 0.001 |
| TPM1 | 0.778 | 0.048 | 0.743 | 0.012 | 0.783 | 0.032 | 0.811 | 0.046 |
| TPM2 | 0.578 | <.001 | 0.634 | <.001 | 0.611 | <.001 | 0.710 | 0.001 |
| TPP2 | | | 0.775 | 0.037 | | | | |
| TRAF3IP2 | 0.722 | 0.002 | 0.690 | <.001 | 0.792 | 0.021 | 0.823 | 0.049 |
| TRO | 0.744 | 0.003 | 0.725 | 0.003 | 0.765 | 0.002 | 0.821 | 0.041 |
| TUBB2A | 0.639 | <.001 | 0.625 | <.001 | | | | |
| TYMP | 0.786 | 0.039 | | | | | | |
| VCL | 0.594 | <.001 | 0.657 | 0.001 | 0.682 | <.001 | | |
| VEGFA | | | 0.762 | 0.024 | | | | |
| VEGFB | 0.795 | 0.037 | | | | | | |
| VIM | 0.739 | 0.009 | | | 0.791 | 0.021 | | |

TABLE 4B-continued

Genes significantly (p < 0.05) associated with cRFI or bRFI in the primary Gleason pattern or highest Gleason pattern with hazard ratio (HR) <1.0 (increased expression is positively associated with good prognosis)

| Official Symbol | cRFI Primary Pattern HR | p-value | cRFI Highest Pattern HR | p-value | bRFI Primary Pattern HR | p-value | bRFI Highest Pattern HR | p-value |
|---|---|---|---|---|---|---|---|---|
| WDR19 | | | | | | | 0.776 | 0.015 |
| WFDC1 | | | | | 0.746 | <.001 | | |
| YY1 | 0.683 | 0.001 | | | 0.728 | 0.002 | | |
| ZFHX3 | 0.684 | <.001 | 0.661 | <.001 | 0.801 | 0.010 | 0.762 | 0.001 |
| ZFP36 | 0.605 | <.001 | 0.579 | <.001 | | | 0.815 | 0.043 |
| ZNF827 | 0.624 | <.001 | 0.730 | 0.007 | 0.738 | 0.004 | | |

Tables 5A and 5B provide genes that were significantly associated (p<0.05), positively or negatively, with recurrence (cRFI, bRFI) after adjusting for AUA risk group in the primary and/or highest Gleason pattern. Increased expression of genes in Table 5A is negatively associated with good prognosis, while increased expression of genes in Table 5B is positively associated with good prognosis.

TABLE 5A

Gene significantly (p < 0.05) associated with cRFI or bRFI after adjustment for AUA risk group in the primary Gleason pattern or highest Gleason pattern with hazard ratio (HR) >1.0 (increased expression negatively associated with good prognosis)

| Official Symbol | cRFI Primary Pattern HR | p-value | cRFI Highest Pattern HR | p-value | bRFI Primary Pattern HR | p-value | bRFI Highest Pattern HR | p-value |
|---|---|---|---|---|---|---|---|---|
| AKR1C3 | 1.315 | 0.018 | 1.283 | 0.024 | | | | |
| ALOX12 | | | | | | | 1.198 | 0.024 |
| ANLN | 1.406 | <.001 | 1.519 | <.001 | 1.485 | <.001 | 1.632 | <.001 |
| AQP2 | 1.209 | <.001 | 1.302 | <.001 | | | | |
| ASAP2 | | | 1.582 | <.001 | 1.333 | 0.011 | 1.307 | 0.019 |
| ASPN | 1.872 | <.001 | 1.741 | <.001 | 1.638 | <.001 | 1.691 | <.001 |
| ATP5E | 1.309 | 0.042 | 1.369 | 0.012 | | | | |
| BAG5 | | | 1.291 | 0.044 | | | | |
| BAX | | | | | 1.298 | 0.025 | 1.420 | 0.004 |
| BGN | 1.746 | <.001 | 1.755 | <.001 | | | | |
| BIRC5 | 1.480 | <.001 | 1.470 | <.001 | 1.419 | <.001 | 1.503 | <.001 |
| BMP6 | 1.536 | <.001 | 1.815 | <.001 | 1.294 | 0.033 | 1.429 | 0.001 |
| BRCA2 | | | | | | | 1.184 | 0.037 |
| BUB1 | 1.288 | 0.001 | 1.391 | <.001 | 1.254 | <.001 | 1.189 | 0.018 |
| CACNA1D | | | 1.313 | 0.029 | | | | |
| CADPS | | | | | 1.358 | 0.007 | 1.267 | 0.022 |
| CASP3 | | | | | 1.251 | 0.037 | | |
| CCNB1 | | | | | 1.261 | 0.033 | 1.318 | 0.005 |
| CCNE2 | 1.345 | 0.005 | 1.438 | <.001 | 1.606 | <.001 | 1.426 | <.001 |
| CD276 | 1.482 | 0.002 | 1.668 | <.001 | 1.451 | <.001 | 1.302 | 0.011 |
| CDC20 | 1.417 | <.001 | 1.547 | <.001 | 1.355 | <.001 | 1.446 | <.001 |
| CDC6 | 1.340 | 0.011 | 1.265 | 0.046 | 1.367 | 0.002 | 1.272 | 0.025 |
| CDH7 | 1.402 | 0.003 | 1.409 | 0.002 | | | | |
| CDKN2B | 1.553 | <.001 | 1.746 | <.001 | 1.340 | 0.014 | 1.369 | 0.006 |
| CDKN2C | 1.411 | <.001 | 1.604 | <.001 | 1.220 | 0.033 | | |
| CDKN3 | 1.296 | 0.004 | | | 1.226 | 0.015 | | |
| CENPF | 1.434 | 0.002 | 1.570 | <.001 | 1.633 | <.001 | 1.610 | <.001 |
| CKS2 | 1.419 | 0.008 | 1.374 | 0.022 | 1.380 | 0.004 | | |
| COL1A1 | 1.677 | <.001 | 1.809 | <.001 | 1.401 | <.001 | 1.352 | 0.003 |
| COL1A2 | | | 1.373 | 0.010 | | | | |
| COL3A1 | 1.669 | <.001 | 1.781 | <.001 | 1.249 | 0.024 | 1.234 | 0.047 |
| COL4A1 | 1.475 | 0.002 | 1.513 | 0.002 | | | | |
| COL8A1 | 1.506 | 0.001 | 1.691 | <.001 | | | | |
| CRISP3 | 1.406 | 0.004 | 1.471 | <.001 | | | | |
| CTHRC1 | 1.426 | 0.009 | 1.793 | <.001 | 1.311 | 0.019 | | |
| CTNND2 | | | | | 1.462 | <.001 | | |
| DDIT4 | 1.478 | 0.003 | 1.783 | <.001 | | | 1.236 | 0.039 |
| DYNLL1 | 1.431 | 0.002 | | | | | 1.193 | 0.004 |
| EIF3H | | | | | 1.372 | 0.027 | | |
| ENY2 | | | | | 1.325 | 0.023 | 1.270 | 0.017 |
| ERG | 1.303 | 0.041 | | | | | | |
| EZH2 | | | 1.254 | 0.049 | | | | |
| F2R | 1.540 | 0.002 | 1.448 | 0.006 | 1.286 | 0.023 | | |
| FADD | 1.235 | 0.041 | 1.404 | <.001 | | | | |
| FAP | 1.386 | 0.015 | 1.440 | 0.008 | 1.253 | 0.048 | | |

TABLE 5A-continued

Gene significantly (p < 0.05) associated with cRFI or bRFI after adjustment for AUA risk group in the primary Gleason pattern or highest Gleason pattern with hazard ratio (HR) >1.0 (increased expression negatively associated with good prognosis)

| Official Symbol | cRFI Primary Pattern | | cRFI Highest Pattern | | bRFI Primary Pattern | | bRFI Highest Pattern | |
|---|---|---|---|---|---|---|---|---|
| | HR | p-value | HR | p-value | HR | p-value | HR | p-value |
| FASN | 1.303 | 0.028 | | | | | | |
| FCGR3A | | | 1.439 | 0.011 | | | 1.262 | 0.045 |
| FGF5 | 1.289 | 0.006 | | | | | | |
| GNPTAB | 1.290 | 0.033 | 1.369 | 0.022 | 1.285 | 0.018 | 1.355 | 0.008 |
| GPR68 | | | 1.396 | 0.005 | | | | |
| GREM1 | 1.341 | 0.022 | 1.502 | 0.003 | 1.366 | 0.006 | | |
| HDAC1 | | | | | 1.329 | 0.016 | | |
| HDAC9 | | | 1.378 | 0.012 | | | | |
| HRAS | 1.465 | 0.006 | | | | | | |
| HSD17B4 | | | | | 1.442 | <.001 | 1.245 | 0.028 |
| IGFBP3 | | | 1.366 | 0.019 | | | 1.302 | 0.011 |
| INHBA | 2.000 | <.001 | 2.336 | <.001 | | | 1.486 | 0.002 |
| JAG1 | 1.251 | 0.039 | | | | | | |
| KCNN2 | 1.347 | 0.020 | 1.524 | <.001 | 1.312 | 0.023 | 1.346 | 0.011 |
| KHDRBS3 | | | 1.500 | 0.001 | 1.426 | 0.001 | 1.267 | 0.032 |
| KIAA0196 | | | | | | | 1.272 | 0.028 |
| KIF4A | 1.199 | 0.022 | | | | | 1.262 | 0.004 |
| KPNA2 | | | | | 1.252 | 0.016 | | |
| LAMA3 | | | | | 1.332 | 0.004 | 1.356 | 0.010 |
| LAMB1 | | | 1.317 | 0.028 | | | | |
| LAMC1 | 1.516 | 0.003 | 1.302 | 0.040 | | | 1.397 | 0.007 |
| LIMS1 | | | | | | | 1.261 | 0.027 |
| LOX | | | | | 1.265 | 0.016 | 1.372 | 0.001 |
| LTBP2 | | | 1.477 | 0.002 | | | | |
| LUM | | | 1.321 | 0.020 | | | | |
| MANF | | | | | 1.647 | <.001 | 1.284 | 0.027 |
| MCM2 | | | | | 1.372 | 0.003 | 1.302 | 0.032 |
| MCM3 | | | 1.269 | 0.047 | | | | |
| MCM6 | | | 1.276 | 0.033 | | | 1.245 | 0.037 |
| MELK | | | 1.294 | 0.005 | 1.394 | <.001 | | |
| MKI67 | 1.253 | 0.028 | 1.246 | 0.029 | | | | |
| MMP11 | 1.557 | <.001 | 1.290 | 0.035 | 1.357 | 0.005 | | |
| MRPL13 | | | | | | | 1.275 | 0.003 |
| MSH2 | | | 1.355 | 0.009 | | | | |
| MYBL2 | 1.497 | <.001 | 1.509 | <.001 | 1.304 | 0.003 | 1.292 | 0.007 |
| MYO6 | | | 1.367 | 0.010 | | | | |
| NDRG1 | 1.270 | 0.042 | | | | | 1.314 | 0.025 |
| NEK2 | | | 1.338 | 0.020 | | | 1.269 | 0.026 |
| NETO2 | 1.434 | 0.004 | 1.303 | 0.033 | 1.283 | 0.012 | | |
| NOX4 | 1.413 | 0.006 | 1.308 | 0.037 | 1.444 | <.001 | | |
| NRIP3 | | | | | | | 1.171 | 0.026 |
| NRP1 | | | 1.372 | 0.020 | | | | |
| ODC1 | | | | | 1.450 | <.001 | | |
| OR51E1 | | | | | 1.559 | <.001 | 1.413 | 0.008 |
| PAK6 | | | | | | | 1.233 | 0.047 |
| PATE1 | 1.262 | <.001 | 1.375 | <.001 | 1.143 | 0.034 | 1.191 | 0.036 |
| PCNA | | | | | 1.227 | 0.033 | 1.318 | 0.003 |
| PEX10 | 1.517 | <.001 | 1.500 | 0.001 | | | | |
| PGD | 1.363 | 0.028 | 1.316 | 0.039 | 1.652 | <.001 | | |
| PGK1 | | | 1.224 | 0.034 | | | 1.206 | 0.024 |
| PIM1 | | | | | 1.205 | 0.042 | | |
| PLA2G7 | | | | | 1.298 | 0.018 | 1.358 | 0.005 |
| PLAU | | | | | 1.242 | 0.032 | | |
| PLK1 | | | 1.464 | 0.001 | 1.299 | 0.018 | 1.275 | 0.031 |
| PLOD2 | | | | | 1.206 | 0.039 | 1.261 | 0.025 |
| POSTN | 1.558 | 0.001 | 1.356 | 0.022 | 1.363 | 0.009 | | |
| PPP3CA | | | | | 1.445 | 0.002 | | |
| PSMD13 | | | | | 1.301 | 0.017 | 1.411 | 0.003 |
| PTK2 | | | 1.318 | 0.031 | | | | |
| PTK6 | 1.582 | <.001 | 1.894 | <.001 | 1.290 | 0.011 | 1.354 | 0.003 |
| PTTG1 | 1.319 | 0.004 | 1.430 | <.001 | 1.271 | 0.006 | 1.492 | <.001 |
| RAD21 | | | 1.278 | 0.028 | 1.435 | 0.004 | 1.326 | 0.008 |
| RAF1 | | | | | 1.504 | <.001 | | |
| RALA | 1.374 | 0.028 | | | 1.459 | 0.001 | | |
| RGS7 | | | 1.203 | 0.031 | | | | |
| RRM1 | 1.535 | 0.001 | 1.525 | <.001 | | | | |
| RRM2 | 1.302 | 0.003 | 1.197 | 0.047 | 1.342 | <.001 | | |
| SAT1 | 1.374 | 0.043 | | | | | | |
| SDC1 | | | | | 1.344 | 0.011 | 1.473 | 0.008 |
| SEC14L1 | | | | | | | 1.297 | 0.006 |
| SESN3 | 1.337 | 0.002 | 1.495 | <.001 | | | 1.223 | 0.038 |

TABLE 5A-continued

Gene significantly (p < 0.05) associated with cRFI or bRFI after adjustment for AUA risk group in the primary Gleason pattern or highest Gleason pattern with hazard ratio (HR) >1.0 (increased expression negatively associated with good prognosis)

| Official Symbol | cRFI Primary Pattern HR | p-value | cRFI Highest Pattern HR | p-value | bRFI Primary Pattern HR | p-value | bRFI Highest Pattern HR | p-value |
|---|---|---|---|---|---|---|---|---|
| SFRP4 | 1.610 | <.001 | 1.542 | 0.002 | 1.370 | 0.009 | | |
| SHMT2 | 1.567 | 0.001 | 1.522 | <.001 | 1.485 | 0.001 | 1.370 | <.001 |
| SKIL | | | | | 1.303 | 0.008 | | |
| SLC25A21 | | | | | 1.287 | 0.020 | 1.306 | 0.017 |
| SLC44A1 | | | 1.308 | 0.045 | | | | |
| SNRPB2 | 1.304 | 0.018 | | | | | | |
| SOX4 | | | | | 1.252 | 0.031 | | |
| SPARC | 1.445 | 0.004 | 1.706 | <.001 | | | 1.269 | 0.026 |
| SPP1 | | | 1.376 | 0.016 | | | | |
| SQLE | | | 1.417 | 0.007 | 1.262 | 0.035 | | |
| STAT1 | | | | | | | 1.209 | 0.029 |
| STMN1 | 1.315 | 0.029 | | | | | | |
| SULF1 | | | 1.504 | 0.001 | | | | |
| TAF2 | | | | | 1.252 | 0.048 | 1.301 | 0.019 |
| TFDP1 | | | | | 1.395 | 0.010 | 1.424 | 0.002 |
| THBS2 | 1.716 | <.001 | 1.719 | <.001 | | | | |
| THY1 | 1.343 | 0.035 | 1.575 | 0.001 | | | | |
| TK1 | | | | | 1.320 | <.001 | 1.304 | <.001 |
| TOP2A | 1.464 | 0.001 | 1.688 | <.001 | 1.715 | <.001 | 1.761 | <.001 |
| TPD52 | | | | | 1.286 | 0.006 | 1.258 | 0.023 |
| TPX2 | 1.644 | <.001 | 1.964 | <.001 | 1.699 | <.001 | 1.754 | <.001 |
| TYMS | | | | | | | 1.315 | 0.014 |
| UBE2C | 1.270 | 0.019 | 1.558 | <.001 | 1.205 | 0.027 | 1.333 | <.001 |
| UBE2G1 | 1.302 | 0.041 | | | | | | |
| UBE2T | 1.451 | <.001 | | | 1.309 | 0.003 | | |
| UGT2B15 | | | 1.222 | 0.025 | | | | |
| UHRF1 | 1.370 | 0.003 | 1.520 | <.001 | 1.247 | 0.020 | | |
| VCPIP1 | | | 1.332 | 0.015 | | | | |
| VTI1B | | | | | 1.237 | 0.036 | | |
| XIAP | | | | | 1.486 | 0.008 | | |
| ZMYND8 | | | 1.408 | 0.007 | | | | |
| ZNF3 | | | | | | | 1.284 | 0.018 |
| ZWINT | 1.289 | 0.028 | | | | | | |

TABLE 5B

Genes significantly (p < 0.05) associated with cRFI or bRFI after adjustment for AUA risk group in the primary Gleason pattern or highest Gleason pattern with hazard ratio (HR) <1.0 (increased expression is positively associated with good prognosis)

| Official Symbol | cRFI Primary Pattern HR | p-value | cRFI Highest Pattern HR | p-value | bRFI Primary Pattern HR | p-value | bRFI Highest Pattern HR | p-value |
|---|---|---|---|---|---|---|---|---|
| AAMP | 0.535 | <.001 | 0.581 | <.001 | 0.700 | 0.002 | 0.759 | 0.006 |
| ABCA5 | 0.798 | 0.007 | 0.745 | 0.002 | | | 0.841 | 0.037 |
| ABCC1 | | | 0.800 | 0.044 | | | | |
| ABCC4 | | | 0.787 | 0.022 | | | | |
| ABHD2 | | | 0.768 | 0.023 | | | | |
| ACOX2 | 0.678 | 0.002 | 0.749 | 0.027 | 0.759 | 0.004 | | |
| ADH5 | 0.645 | <.001 | 0.672 | 0.001 | | | | |
| AGTR1 | 0.780 | 0.030 | | | | | | |
| AKAP1 | 0.815 | 0.045 | 0.758 | <.001 | | | | |
| AKT1 | | | 0.732 | 0.010 | | | | |
| ALDH1A2 | 0.646 | <.001 | 0.548 | <.001 | 0.671 | <.001 | 0.713 | 0.001 |
| ANPEP | 0.641 | <.001 | 0.535 | <.001 | | | | |
| ANXA2 | 0.772 | 0.035 | | | 0.804 | 0.046 | | |
| ATXN1 | 0.654 | <.001 | 0.754 | 0.020 | 0.797 | 0.017 | | |
| AURKA | | | 0.788 | 0.030 | | | | |
| AXIN2 | 0.744 | 0.005 | 0.655 | <.001 | | | | |
| AZGP1 | 0.656 | <.001 | 0.676 | <.001 | 0.754 | 0.001 | 0.791 | 0.004 |
| BAD | | | 0.700 | 0.004 | | | | |
| BIN1 | 0.650 | <.001 | 0.764 | 0.013 | 0.803 | 0.015 | | |
| BTG3 | | | | | 0.836 | 0.025 | | |
| BTRC | 0.730 | 0.005 | | | | | | |
| C7 | 0.617 | <.001 | 0.680 | <.001 | 0.667 | <.001 | 0.755 | 0.005 |
| CADM1 | 0.559 | <.001 | 0.566 | <.001 | 0.772 | 0.020 | 0.802 | 0.046 |
| CASP1 | 0.781 | 0.030 | 0.779 | 0.021 | 0.818 | 0.027 | 0.828 | 0.036 |
| CAV1 | | | | | 0.775 | 0.034 | | |
| CAV2 | | | 0.677 | 0.019 | | | | |
| CCL2 | | | 0.752 | 0.023 | | | | |
| CCNH | 0.679 | <.001 | 0.682 | <.001 | | | | |
| CD164 | 0.721 | 0.002 | 0.724 | 0.005 | | | | |
| CD1A | | | | | 0.710 | 0.014 | | |
| CD44 | 0.591 | <.001 | 0.642 | <.001 | | | | |
| CD82 | 0.779 | 0.021 | 0.771 | 0.024 | | | | |
| CDC25B | 0.778 | 0.035 | | | 0.818 | 0.023 | | |
| CDK14 | 0.788 | 0.011 | | | | | | |
| CDK3 | 0.752 | 0.012 | | | 0.779 | 0.005 | 0.841 | 0.020 |
| CDKN1A | 0.770 | 0.049 | 0.712 | 0.014 | | | | |
| CDKN1C | 0.684 | <.001 | | | 0.697 | <.001 | | |
| CHN1 | 0.772 | 0.031 | | | | | | |

TABLE 5B-continued

Genes significantly (p < 0.05) associated with cRFI or bRFI after adjustment for AUA risk group in the primary Gleason pattern or highest Gleason pattern with hazard ratio (HR) <1.0 (increased expression is positively associated with good prognosis)

| Official Symbol | cRFI Primary Pattern HR | cRFI Primary Pattern p-value | cRFI Highest Pattern HR | cRFI Highest Pattern p-value | bRFI Primary Pattern HR | bRFI Primary Pattern p-value | bRFI Highest Pattern HR | bRFI Highest Pattern p-value |
|---|---|---|---|---|---|---|---|---|
| COL6A1 | 0.648 | <.001 | 0.807 | 0.046 | 0.768 | 0.004 | | |
| CSF1 | 0.621 | <.001 | 0.671 | 0.001 | | | | |
| CTNNB1 | | | | | 0.905 | 0.008 | | |
| CTSB | 0.754 | 0.030 | 0.716 | 0.011 | 0.756 | 0.014 | | |
| CXCL12 | 0.641 | <.001 | 0.796 | 0.038 | 0.708 | <.001 | | |
| CYP3A5 | 0.503 | <.001 | 0.528 | <.001 | 0.791 | 0.028 | | |
| CYR61 | 0.639 | 0.001 | 0.659 | 0.001 | | | 0.797 | 0.048 |
| DARC | | | | | 0.707 | 0.004 | | |
| DDR2 | | | | | 0.750 | 0.011 | | |
| DES | 0.657 | <.001 | 0.758 | 0.022 | 0.699 | <.001 | | |
| DHRS9 | 0.625 | 0.002 | | | | | | |
| DHX9 | 0.846 | <.001 | | | | | | |
| DIAPH1 | 0.682 | 0.007 | 0.723 | 0.008 | 0.780 | 0.026 | | |
| DLC1 | 0.703 | 0.005 | 0.702 | 0.008 | | | | |
| DLGAP1 | 0.703 | 0.008 | 0.636 | <.001 | | | | |
| DNM3 | 0.701 | 0.001 | | | 0.817 | 0.042 | | |
| DPP4 | 0.686 | <.001 | 0.716 | 0.001 | | | | |
| DPT | 0.636 | <.001 | 0.633 | <.001 | 0.709 | 0.006 | 0.773 | 0.024 |
| DUSP1 | 0.683 | 0.006 | 0.679 | 0.003 | | | | |
| DUSP6 | 0.694 | 0.003 | 0.605 | <.001 | | | | |
| EDN1 | | | | | 0.773 | 0.031 | | |
| EDNRA | 0.716 | 0.007 | | | | | | |
| EGR1 | 0.575 | <.001 | 0.575 | <.001 | | | 0.771 | 0.014 |
| EGR3 | 0.633 | 0.002 | 0.643 | <.001 | | | 0.792 | 0.025 |
| EIF4E | 0.722 | 0.002 | | | | | | |
| ELK4 | 0.710 | 0.009 | 0.759 | 0.027 | | | | |
| ENPP2 | 0.786 | 0.039 | | | | | | |
| EPHA2 | | | 0.593 | 0.001 | | | | |
| EPHA3 | 0.739 | 0.006 | | | 0.802 | 0.020 | | |
| ERBB2 | | | 0.753 | 0.007 | | | | |
| ERBB3 | 0.753 | 0.009 | 0.753 | 0.015 | | | | |
| ERCC1 | | | | | 0.727 | 0.001 | | |
| EREG | | | | | 0.722 | 0.012 | 0.769 | 0.040 |
| ESR1 | | | 0.742 | 0.015 | | | | |
| FABP5 | 0.756 | 0.032 | | | | | | |
| FAM107A | 0.524 | <.001 | 0.579 | <.001 | 0.688 | <.001 | 0.699 | 0.001 |
| FAM13C | 0.639 | <.001 | 0.601 | <.001 | 0.810 | 0.019 | 0.709 | <.001 |
| FAS | 0.770 | 0.033 | | | | | | |
| FASLG | 0.716 | 0.028 | 0.683 | 0.017 | | | | |
| FGF10 | | | | | 0.798 | 0.045 | | |
| FGF17 | | | 0.718 | 0.018 | 0.793 | 0.024 | 0.790 | 0.024 |
| FGFR2 | 0.739 | 0.007 | 0.783 | 0.038 | 0.740 | 0.004 | | |
| FGFR4 | | | 0.746 | 0.050 | | | | |
| FKBP5 | | | 0.689 | 0.003 | | | | |
| FLNA | 0.701 | 0.006 | 0.766 | 0.029 | 0.768 | 0.037 | | |
| FLNC | | | 0.755 | <.001 | | | 0.820 | 0.022 |
| FLT1 | | | 0.729 | 0.008 | | | | |
| FOS | 0.572 | <.001 | 0.536 | <.001 | | | 0.750 | 0.005 |
| FOXQ1 | 0.778 | 0.033 | | | 0.820 | 0.018 | | |
| FYN | 0.708 | 0.006 | | | | | | |
| GADD45B | 0.577 | <.001 | 0.589 | <.001 | | | | |
| GDF15 | 0.757 | 0.013 | 0.743 | 0.006 | | | | |
| GHR | | | 0.712 | 0.004 | | | 0.679 | 0.001 |
| GNRH1 | | | | | 0.791 | 0.048 | | |
| GPM6B | 0.675 | <.001 | 0.660 | <.001 | 0.735 | 0.004 | 0.823 | 0.049 |
| GSK3B | 0.783 | 0.042 | | | | | | |
| GSN | 0.587 | <.001 | 0.705 | 0.002 | 0.745 | 0.004 | 0.796 | 0.021 |
| GSTM1 | 0.686 | 0.001 | 0.631 | <.001 | 0.807 | 0.018 | | |
| GSTM2 | 0.607 | <.001 | 0.683 | <.001 | 0.679 | <.001 | 0.800 | 0.027 |
| HIRIP3 | 0.692 | <.001 | | | 0.782 | 0.007 | | |
| HK1 | 0.724 | 0.002 | 0.718 | 0.002 | | | | |
| HLF | 0.580 | <.001 | 0.571 | <.001 | 0.759 | 0.008 | 0.750 | 0.004 |
| HNF1B | | | 0.669 | <.001 | | | | |
| HPS1 | 0.764 | 0.008 | | | | | | |
| HSD17B10 | 0.802 | 0.045 | | | | | | |
| HSD17B2 | | | 0.723 | 0.048 | | | | |
| HSD3B2 | | | | | 0.709 | 0.010 | | |
| HSP90AB1 | 0.780 | 0.034 | | | 0.809 | 0.041 | | |
| HSPA5 | | | 0.738 | 0.017 | | | | |
| HSPB1 | 0.770 | 0.006 | 0.801 | 0.032 | | | | |
| HSPB2 | | | | | 0.788 | 0.035 | | |
| ICAM1 | 0.728 | 0.015 | 0.716 | 0.010 | | | | |
| IER3 | 0.735 | 0.016 | 0.637 | <.001 | | | 0.802 | 0.035 |
| IFIT1 | 0.647 | <.001 | 0.755 | 0.029 | | | | |
| IGF1 | 0.675 | <.001 | 0.603 | <.001 | 0.762 | 0.006 | 0.770 | 0.030 |
| IGF2 | | | | | 0.761 | 0.011 | | |
| IGFBP2 | 0.601 | <.001 | 0.605 | <.001 | | | | |
| IGFBP5 | 0.702 | <.001 | | | | | | |
| IGFBP6 | 0.628 | <.001 | | | 0.726 | 0.003 | | |
| IL1B | 0.676 | 0.002 | 0.716 | 0.004 | | | | |
| IL6 | 0.688 | 0.005 | 0.766 | 0.044 | | | | |
| IL6R | | | 0.786 | 0.036 | | | | |
| IL6ST | 0.618 | <.001 | 0.639 | <.001 | 0.785 | 0.027 | 0.813 | 0.042 |
| IL8 | 0.635 | <.001 | 0.628 | <.001 | | | | |
| ILK | 0.734 | 0.018 | 0.753 | 0.026 | | | | |
| ING5 | 0.684 | <.001 | 0.681 | <.001 | 0.756 | 0.006 | | |
| ITGA4 | 0.778 | 0.040 | | | | | | |
| ITGA5 | 0.762 | 0.026 | | | | | | |
| ITGA6 | | | 0.811 | 0.038 | | | | |
| ITGA7 | 0.592 | <.001 | 0.715 | 0.006 | 0.710 | 0.002 | | |
| ITGAD | | | 0.576 | 0.006 | | | | |
| ITGB4 | | | 0.693 | 0.003 | | | | |
| ITPR1 | 0.789 | 0.029 | | | | | | |
| JUN | 0.572 | <.001 | 0.581 | <.001 | | | 0.777 | 0.019 |
| JUNB | 0.732 | 0.030 | 0.707 | 0.016 | | | | |
| KCTD12 | 0.758 | 0.036 | | | | | | |
| KIT | | | | | 0.691 | 0.009 | 0.738 | 0.028 |
| KLC1 | 0.741 | 0.024 | | | 0.781 | 0.024 | | |
| KLF6 | 0.733 | 0.018 | 0.727 | 0.014 | | | | |
| KLK1 | | | 0.744 | 0.028 | | | | |
| KLK2 | 0.697 | 0.002 | 0.679 | <.001 | | | | |
| KLK3 | 0.725 | <.001 | 0.715 | <.001 | | | 0.841 | 0.023 |
| KRT15 | 0.660 | <.001 | 0.577 | <.001 | 0.750 | 0.002 | | |
| KRT18 | 0.623 | <.001 | 0.642 | <.001 | 0.702 | <.001 | 0.760 | 0.006 |
| KRT2 | | | | | 0.740 | 0.044 | | |
| KRT5 | 0.674 | <.001 | 0.588 | <.001 | 0.769 | 0.005 | | |
| KRT8 | 0.768 | 0.034 | | | | | | |
| L1CAM | 0.737 | 0.036 | | | | | | |
| LAG3 | 0.711 | 0.013 | 0.748 | 0.029 | | | | |
| LAMA4 | | | | | 0.649 | 0.009 | | |
| LAMB3 | 0.709 | 0.002 | 0.684 | 0.006 | 0.768 | 0.006 | | |
| LGALS3 | 0.652 | <.001 | 0.752 | 0.015 | 0.805 | 0.028 | | |
| LIG3 | 0.728 | 0.016 | 0.667 | <.001 | | | | |
| LRP1 | | | | | | | 0.811 | 0.043 |
| MDM2 | | | 0.788 | 0.033 | | | | |
| MGMT | 0.645 | <.001 | 0.766 | 0.015 | | | | |
| MICA | 0.796 | 0.043 | 0.676 | <.001 | | | | |
| MPPED2 | 0.675 | <.001 | 0.616 | <.001 | 0.750 | 0.006 | | |
| MRC1 | | | | | | | 0.788 | 0.028 |
| MTSS1 | 0.654 | <.001 | | | 0.793 | 0.036 | | |
| MYBPC1 | 0.706 | <.001 | 0.534 | <.001 | 0.773 | 0.004 | 0.692 | <.001 |
| NCAPD3 | 0.658 | <.001 | 0.566 | <.001 | 0.753 | 0.011 | 0.733 | 0.009 |
| NCOR1 | | | 0.838 | 0.045 | | | | |
| NEXN | 0.748 | 0.025 | | | 0.785 | 0.020 | | |
| NFAT5 | 0.531 | <.001 | 0.626 | <.001 | | | | |
| NFATC2 | | | 0.759 | 0.024 | | | | |
| OAZ1 | | | 0.766 | 0.024 | | | | |
| OLFML3 | 0.648 | <.001 | 0.748 | 0.005 | 0.639 | <.001 | 0.675 | <.001 |
| OR51E2 | 0.823 | 0.034 | | | | | | |
| PAGE4 | 0.599 | <.001 | 0.698 | 0.002 | 0.606 | <.001 | 0.726 | <.001 |
| PCA3 | 0.705 | <.001 | 0.647 | <.001 | | | | |
| PCDHGB7 | | | | | | | 0.712 | <.001 |
| PGF | 0.790 | 0.039 | | | | | | |
| PLG | | | | | | | 0.764 | 0.048 |

TABLE 5B-continued

Genes significantly (p < 0.05) associated with cRFI or bRFI after adjustment for AUA risk group in the primary Gleason pattern or highest Gleason pattern with hazard ratio (HR) <1.0 (increased expression is positively associated with good prognosis)

| Official Symbol | cRFI Primary Pattern HR | p-value | cRFI Highest Pattern HR | p-value | bRFI Primary Pattern HR | p-value | bRFI Highest Pattern HR | p-value |
|---|---|---|---|---|---|---|---|---|
| PLP2 | | | 0.766 | 0.037 | | | | |
| PPAP2B | 0.589 | <.001 | 0.647 | <.001 | 0.691 | <.001 | 0.765 | 0.013 |
| PPP1R12A | 0.673 | 0.001 | 0.677 | 0.001 | | | 0.807 | 0.045 |
| PRIMA1 | 0.622 | <.001 | 0.712 | 0.008 | 0.740 | 0.013 | | |
| PRKCA | 0.637 | <.001 | | | 0.694 | <.001 | | |
| PRKCB | 0.741 | 0.020 | | | 0.664 | <.001 | | |
| PROM1 | 0.599 | 0.017 | 0.527 | 0.042 | 0.610 | 0.006 | 0.420 | 0.002 |
| PTCH1 | 0.752 | 0.027 | | | 0.762 | 0.011 | | |
| PTEN | 0.779 | 0.011 | 0.802 | 0.030 | 0.788 | 0.009 | | |
| PTGS2 | 0.639 | <.001 | 0.606 | <.001 | | | | |
| PTHLH | 0.632 | 0.007 | 0.739 | 0.043 | 0.654 | 0.002 | 0.740 | 0.015 |
| PTK2B | | | 0.775 | 0.019 | 0.831 | 0.028 | 0.810 | 0.017 |
| PTPN1 | 0.721 | 0.012 | 0.737 | 0.024 | | | | |
| PYCARD | | | 0.702 | 0.005 | | | | |
| RAB27A | | | 0.736 | 0.008 | | | | |
| RAB30 | 0.761 | 0.011 | | | | | | |
| RARB | | | 0.746 | 0.010 | | | | |
| RASSF1 | 0.805 | 0.043 | | | | | | |
| RHOB | 0.755 | 0.029 | 0.672 | 0.001 | | | | |
| RLN1 | 0.742 | 0.036 | 0.740 | 0.036 | | | | |
| RND3 | 0.607 | <.001 | 0.633 | <.001 | | | | |
| RNF114 | 0.782 | 0.041 | 0.747 | 0.013 | | | | |
| SDC2 | | | | | 0.714 | 0.002 | | |
| SDHC | 0.698 | <.001 | 0.762 | 0.029 | | | | |
| SERPINA3 | | | 0.752 | 0.030 | | | | |
| SERPINB5 | | | 0.669 | 0.014 | | | | |
| SH3RF2 | 0.705 | 0.012 | 0.568 | <.001 | | | 0.755 | 0.016 |
| SLC22A3 | 0.650 | <.001 | 0.582 | <.001 | | | | |
| SMAD4 | 0.636 | <.001 | 0.684 | 0.002 | 0.741 | 0.007 | 0.738 | 0.007 |
| SMARCD1 | 0.757 | 0.001 | | | | | | |
| SMO | 0.790 | 0.049 | | | | | 0.766 | 0.013 |
| SOD1 | 0.741 | 0.037 | 0.713 | 0.007 | | | | |
| SORBS1 | 0.684 | 0.003 | 0.732 | 0.008 | 0.788 | 0.049 | | |
| SPDEF | 0.840 | 0.012 | | | | | | |
| SPINT1 | | | 0.837 | 0.048 | | | | |
| SRC | 0.674 | <.001 | 0.671 | <.001 | | | | |
| SRD5A2 | 0.553 | <.001 | 0.588 | <.001 | 0.618 | <.001 | 0.701 | <.001 |
| ST5 | 0.747 | 0.012 | 0.761 | 0.010 | 0.780 | 0.016 | 0.832 | 0.041 |
| STAT3 | | | 0.735 | 0.020 | | | | |
| STAT5A | 0.731 | 0.005 | 0.743 | 0.009 | | | 0.817 | 0.027 |
| STAT5B | 0.708 | <.001 | 0.696 | 0.001 | | | | |
| SUMO1 | 0.815 | 0.037 | | | | | | |
| SVIL | 0.689 | 0.003 | 0.739 | 0.008 | 0.761 | 0.011 | | |
| TBP | 0.792 | 0.037 | | | | | | |
| TFF3 | 0.719 | 0.007 | 0.664 | 0.001 | | | | |
| TGFB1I1 | 0.676 | 0.003 | 0.707 | 0.007 | 0.709 | 0.005 | 0.777 | 0.035 |
| TGFB2 | 0.741 | 0.010 | 0.785 | 0.017 | | | | |
| TGFBR2 | | | | | 0.759 | 0.022 | | |
| TIMP3 | | | | | 0.785 | 0.037 | | |
| TMPRSS2 | 0.780 | 0.012 | 0.742 | <.001 | | | | |
| TNF | | | 0.654 | 0.007 | | | 0.682 | 0.006 |
| TNFRSF10B | 0.623 | <.001 | 0.681 | <.001 | 0.801 | 0.018 | 0.815 | 0.019 |
| TNFSF10 | 0.721 | 0.004 | | | | | | |
| TP53 | | | 0.759 | 0.011 | | | | |
| TP63 | | | 0.737 | 0.020 | 0.754 | 0.007 | | |
| TPM2 | 0.609 | <.001 | 0.671 | <.001 | 0.673 | <.001 | 0.789 | 0.031 |
| TRAF3IP2 | 0.795 | 0.041 | 0.727 | 0.005 | | | | |
| TRO | 0.793 | 0.033 | 0.768 | 0.023 | 0.814 | 0.023 | | |
| TUBB2A | 0.626 | <.001 | 0.590 | <.001 | | | | |
| VCL | 0.613 | <.001 | 0.701 | 0.011 | | | | |
| VIM | 0.716 | 0.005 | | | 0.792 | 0.025 | | |
| WFDC1 | | | 0.824 | 0.029 | | | | |
| YY1 | 0.668 | <.001 | 0.787 | 0.014 | 0.716 | 0.001 | 0.819 | 0.011 |
| ZFHX3 | 0.732 | <.001 | 0.709 | <.001 | | | | |
| ZFP36 | 0.656 | 0.001 | 0.609 | <.001 | | | 0.818 | 0.045 |
| ZNF827 | 0.750 | 0.022 | | | | | | |

Tables 6A and 6B provide genes that were significantly associated (p<0.05), positively or negatively, with recurrence (cRFI, bRFI) after adjusting for Gleason pattern in the primary and/or highest Gleason pattern. Increased expression of genes in Table 6A is negatively associated with good prognosis, while increased expression of gene in Table 6B is positively associated with good prognosis.

TABLE 6A

Genes significantly (p < 0.05) associated with cRFI or bRFI after adjustment for Gleason pattern in the primary Gleason pattern or highest Gleason pattern with a hazard ratio (HR) >1.0 (increased expression is negatively associated with good prognosis)

| Table 6A Official Symbol | cRFI Primary Pattern HR | p-value | cRFI Highest Pattern HR | p-value | bRFI Primary Pattern HR | p-value | bRFI Highest Pattern HR | p-value |
|---|---|---|---|---|---|---|---|---|
| AKR1C3 | 1.258 | 0.039 | | | | | | |
| ANLN | 1.292 | 0.023 | | | 1.449 | <.001 | 1.420 | 0.001 |
| AQP2 | 1.178 | 0.008 | 1.287 | <.001 | | | | |
| ASAP2 | | | 1.396 | 0.015 | | | | |
| ASPN | 1.809 | <.001 | 1.508 | 0.009 | 1.506 | 0.002 | 1.438 | 0.002 |
| BAG5 | | | 1.367 | 0.012 | | | | |
| BAX | | | | | | | 1.234 | 0.044 |
| BGN | 1.465 | 0.009 | 1.342 | 0.046 | | | | |
| BIRC5 | 1.338 | 0.008 | | | 1.364 | 0.004 | 1.279 | 0.006 |
| BMP6 | 1.369 | 0.015 | 1.518 | 0.002 | | | | |
| BUB1 | 1.239 | 0.024 | 1.227 | 0.001 | 1.236 | 0.004 | | |
| CACNA1D | | | 1.337 | 0.025 | | | | |
| CADPS | | | | | 1.280 | 0.029 | | |
| CCNE2 | | | 1.256 | 0.043 | 1.577 | <.001 | 1.324 | 0.001 |
| CD276 | 1.320 | 0.029 | 1.396 | 0.007 | 1.279 | 0.033 | | |
| CDC20 | 1.298 | 0.016 | 1.334 | 0.002 | 1.257 | 0.032 | 1.279 | 0.003 |
| CDH7 | 1.258 | 0.047 | 1.338 | 0.013 | | | | |
| CDKN2B | 1.342 | 0.032 | 1.488 | 0.009 | | | | |
| CDKN2C | 1.344 | 0.010 | 1.450 | <.001 | | | | |
| CDKN3 | 1.284 | 0.012 | | | | | | |
| CENPF | 1.289 | 0.048 | | | 1.498 | 0.001 | 1.344 | 0.010 |
| COL1A1 | 1.481 | 0.003 | 1.506 | 0.002 | | | | |
| COL3A1 | 1.459 | 0.004 | 1.430 | 0.013 | | | | |
| COL4A1 | 1.396 | 0.015 | | | | | | |
| COL8A1 | 1.413 | 0.008 | | | | | | |
| CRISP3 | 1.346 | 0.012 | 1.310 | 0.025 | | | | |
| CTHRC1 | | | 1.588 | 0.002 | | | | |
| DDIT4 | 1.363 | 0.020 | 1.379 | 0.028 | | | | |
| DICER1 | | | | | | | 1.294 | 0.008 |
| ENY2 | | | | | 1.269 | 0.024 | | |
| FADD | | | 1.307 | 0.010 | | | | |
| FAS | | | | | | | 1.243 | 0.025 |
| FGF5 | 1.328 | 0.002 | | | | | | |
| GNPTAB | | | | | | | 1.246 | 0.037 |
| GREM1 | 1.332 | 0.024 | 1.377 | 0.013 | 1.373 | 0.011 | | |
| HDAC1 | | | | | 1.301 | 0.018 | 1.237 | 0.021 |
| HSD17B4 | | | | | | | 1.277 | 0.011 |
| IFN-γ | | | | | 1.219 | 0.048 | | |
| IMMT | | | | | | | 1.230 | 0.049 |
| INHBA | 1.866 | <.001 | 1.944 | <.001 | | | | |
| JAG1 | | | 1.298 | 0.030 | | | | |
| KCNN2 | | | 1.378 | 0.020 | | | 1.282 | 0.017 |
| KHDRBS3 | | | 1.353 | 0.029 | 1.305 | 0.014 | | |
| LAMA3 | | | | | 1.344 | <.001 | 1.232 | 0.048 |
| LAMC1 | 1.396 | 0.015 | | | | | | |
| LIMS1 | | | | | | | 1.337 | 0.004 |
| LOX | | | | | 1.355 | 0.001 | 1.341 | 0.002 |
| LTBP2 | | | 1.304 | 0.045 | | | | |
| MAGEA4 | 1.215 | 0.024 | | | | | | |
| MANF | | | | | 1.460 | <.001 | | |
| MCM6 | | | 1.287 | 0.042 | | | 1.214 | 0.046 |
| MELK | | | 1.329 | 0.002 | | | | |
| MMP11 | 1.281 | 0.050 | | | | | | |
| MRPL13 | | | | | | | 1.266 | 0.021 |
| MYBL2 | 1.453 | <.001 | | | 1.274 | 0.019 | | |
| MYC | | | | | 1.265 | 0.037 | | |
| MYO6 | | | 1.278 | 0.047 | | | | |

TABLE 6A-continued

Genes significantly (p < 0.05) associated with cRFI or bRFI after adjustment for Gleason pattern in the primary Gleason pattern or highest Gleason pattern with a hazard ratio (HR) >1.0 (increased expression is negatively associated with good prognosis)

| Table 6A Official Symbol | cRFI Primary Pattern | | cRFI Highest Pattern | | bRFI Primary Pattern | | bRFI Highest Pattern | |
|---|---|---|---|---|---|---|---|---|
| | HR | p-value | HR | p-value | HR | p-value | HR | p-value |
| NETO2 | 1.322 | 0.022 | | | | | | |
| NFKB1 | | | | | | | 1.255 | 0.032 |
| NOX4 | | | | | 1.266 | 0.041 | | |
| OR51E1 | | | | | 1.566 | <.001 | 1.428 | 0.003 |
| PATE1 | 1.242 | <.001 | 1.347 | <.001 | | | 1.177 | 0.011 |
| PCNA | | | | | | | 1.251 | 0.025 |
| PEX10 | | | 1.302 | 0.028 | | | | |
| PGD | | | 1.335 | 0.045 | 1.379 | 0.014 | 1.274 | 0.025 |
| PIM1 | | | | | 1.254 | 0.019 | | |
| PLA2G7 | | | | | 1.289 | 0.025 | 1.250 | 0.031 |
| PLAU | | | | | 1.267 | 0.031 | | |
| PSMD13 | | | | | | | 1.333 | 0.005 |
| PTK6 | 1.432 | <.001 | 1.577 | <.001 | 1.223 | 0.040 | | |
| PTTG1 | | | | | 1.279 | 0.013 | 1.308 | 0.006 |
| RAGE | | | | | | | 1.329 | 0.011 |
| RALA | 1.363 | 0.044 | | | 1.471 | 0.003 | | |
| RGS7 | 1.120 | 0.040 | 1.173 | 0.031 | | | | |
| RRM1 | 1.490 | 0.004 | 1.527 | <.001 | | | | |
| SESN3 | | | 1.353 | 0.017 | | | | |
| SFRP4 | 1.370 | 0.025 | | | | | | |
| SHMT2 | 1.460 | 0.008 | 1.410 | 0.006 | 1.407 | 0.008 | 1.345 | <.001 |
| SKIL | | | | | 1.307 | 0.025 | | |
| SLC25A21 | | | | | 1.414 | 0.002 | 1.330 | 0.004 |
| SMARCC2 | | | | | 1.219 | 0.049 | | |
| SPARC | | | 1.431 | 0.005 | | | | |
| TFDP1 | | | | | 1.283 | 0.046 | 1.345 | 0.003 |
| THBS2 | 1.456 | 0.005 | 1.431 | 0.012 | | | | |
| TK1 | | | | | 1.214 | 0.015 | 1.222 | 0.006 |
| TOP2A | | | 1.367 | 0.018 | 1.518 | 0.001 | 1.480 | <.001 |
| TPX2 | 1.513 | 0.001 | 1.607 | <.001 | 1.588 | <.001 | 1.481 | <.001 |
| UBE2T | 1.409 | 0.002 | | | | | | |
| UGT2B15 | | | 1.216 | 0.009 | 1.285 | 0.018 | | |
| XIAP | | | | | 1.336 | 0.037 | 1.182 | 0.021 |
| | | | | | | | 1.194 | 0.043 |

TABLE 6B

Genes significantly (p < 0.05) associated with cRFI or bRFI after adjustment for Gleason pattern in the primary Gleason pattern or highest Gleason pattern with hazard ration (HR) <1.0 (increased expression is positively associated with good prognosis)

| Table 6B Official Symbol | cRFI Primary Pattern | | cRFI Highest Pattern | | bRFI Primary Pattern | | bRFI Highest Pattern | |
|---|---|---|---|---|---|---|---|---|
| | HR | p-value | HR | p-value | HR | p-value | HR | p-value |
| AAMP | 0.660 | 0.001 | 0.675 | <.001 | | | 0.836 | 0.045 |
| ABCA5 | 0.807 | 0.014 | 0.737 | <.001 | | | 0.845 | 0.030 |
| ABCC1 | 0.780 | 0.038 | 0.794 | 0.015 | | | | |
| ABCG2 | | | | | | | 0.807 | 0.035 |
| ABHD2 | | | 0.720 | 0.002 | | | | |
| ADH5 | 0.750 | 0.034 | | | | | | |
| AKAP1 | | | 0.721 | <.001 | | | | |
| ALDH1A2 | 0.735 | 0.009 | 0.592 | <.001 | 0.756 | 0.007 | 0.781 | 0.021 |
| ANGPT2 | | | | | 0.741 | 0.036 | | |
| ANPEP | 0.637 | <.001 | 0.536 | <.001 | | | | |
| ANXA2 | | | 0.762 | 0.044 | | | | |
| APOE | | | 0.707 | 0.013 | | | | |
| APRT | | | 0.727 | 0.004 | | | 0.771 | 0.006 |
| ATXN1 | 0.725 | 0.013 | | | | | | |
| AURKA | 0.784 | 0.037 | 0.735 | 0.003 | | | | |
| AXIN2 | 0.744 | 0.004 | 0.630 | <.001 | | | | |
| AZGP1 | 0.672 | <.001 | 0.720 | <.001 | 0.764 | 0.001 | | |
| BAD | | | 0.687 | <.001 | | | | |
| BAK1 | | | 0.783 | 0.014 | | | | |
| BCL2 | 0.777 | 0.033 | 0.772 | 0.036 | | | | |
| BIK | | | 0.768 | 0.040 | | | | |
| BIN1 | 0.691 | <.001 | | | | | | |
| BTRC | | | 0.776 | 0.029 | | | | |
| C7 | 0.707 | 0.004 | | | 0.791 | 0.024 | | |
| CADM1 | 0.587 | <.001 | 0.593 | <.001 | | | | |
| CASP1 | 0.773 | 0.023 | | | 0.820 | 0.025 | | |
| CAV1 | | | | | 0.753 | 0.014 | | |
| CAV2 | | | 0.627 | 0.009 | | | 0.682 | 0.003 |
| CCL2 | | | 0.740 | 0.019 | | | | |
| CCNH | 0.736 | 0.003 | | | | | | |
| CCR1 | | | 0.755 | 0.022 | | | | |
| CD1A | | | | | 0.740 | 0.025 | | |
| CD44 | 0.590 | <.001 | 0.637 | <.001 | | | | |
| CD68 | 0.757 | 0.026 | | | | | | |
| CD82 | 0.778 | 0.012 | 0.759 | 0.016 | | | | |
| CDC25B | 0.760 | 0.021 | | | | | | |
| CDK3 | 0.762 | 0.024 | | | 0.774 | 0.007 | | |
| CDKN1A | | | 0.714 | 0.015 | | | | |
| CDKN1C | 0.738 | 0.014 | | | 0.768 | 0.021 | | |
| COL6A1 | 0.690 | <.001 | 0.805 | 0.048 | | | | |
| CSF1 | 0.675 | 0.002 | 0.779 | 0.036 | | | | |
| CSK | | | | | 0.825 | 0.004 | | |
| CTNNB1 | 0.884 | 0.045 | | | 0.888 | 0.027 | | |
| CTSB | 0.740 | 0.017 | 0.676 | 0.003 | 0.755 | 0.010 | | |
| CTSD | 0.673 | 0.031 | 0.722 | 0.009 | | | | |
| CTSK | | | | | 0.804 | 0.034 | | |
| CTSL2 | | | 0.748 | 0.019 | | | | |
| CXCL12 | 0.731 | 0.017 | | | | | | |
| CYP3A5 | 0.523 | <.001 | 0.518 | <.001 | | | | |
| CYR61 | 0.744 | 0.041 | | | | | | |
| DAP | | | | | 0.755 | 0.011 | | |
| DARC | | | | | 0.763 | 0.029 | | |
| DDR2 | | | | | | | 0.813 | 0.041 |
| DES | 0.743 | 0.020 | | | | | | |
| DHRS9 | 0.606 | 0.001 | | | | | | |
| DHX9 | 0.916 | 0.021 | | | | | | |
| DIAPH1 | 0.749 | 0.036 | 0.688 | 0.003 | | | | |
| DLGAP1 | 0.758 | 0.042 | 0.676 | 0.002 | | | | |
| DLL4 | | | | | | | 0.779 | 0.010 |
| DNM3 | 0.732 | 0.007 | | | | | | |
| DPP4 | 0.732 | 0.004 | 0.750 | 0.014 | | | | |
| DPT | | | 0.704 | 0.014 | | | | |
| DUSP6 | 0.662 | <.001 | 0.665 | 0.001 | | | | |
| EBNA1BP2 | | | | | | | 0.828 | 0.019 |
| EDNRA | 0.782 | 0.048 | | | | | | |
| EGF | | | 0.712 | 0.023 | | | | |
| EGR1 | 0.678 | 0.004 | 0.725 | 0.028 | | | | |
| EGR3 | 0.680 | 0.006 | 0.738 | 0.027 | | | | |
| EIF2C2 | | | 0.789 | 0.032 | | | | |
| EIF2S3 | | | | | | | 0.759 | 0.012 |
| ELK4 | 0.745 | 0.024 | | | | | | |
| EPHA2 | | | 0.661 | 0.007 | | | | |
| EPHA3 | 0.781 | 0.026 | | | | | 0.828 | 0.037 |
| ERBB2 | 0.791 | 0.022 | 0.760 | 0.014 | 0.789 | 0.006 | | |
| ERBB3 | | | 0.757 | 0.009 | | | | |
| ERCC1 | | | | | | | 0.760 | 0.008 |
| ESR1 | | | 0.742 | 0.014 | | | | |
| ESR2 | | | 0.711 | 0.038 | | | | |
| ETV4 | | | 0.714 | 0.035 | | | | |
| FAM107A | 0.619 | <.001 | 0.710 | 0.011 | | | 0.781 | 0.019 |
| FAM13C | 0.664 | <.001 | 0.686 | <.001 | | | 0.813 | 0.014 |
| FAM49B | 0.670 | <.001 | 0.793 | 0.014 | 0.815 | 0.044 | 0.843 | 0.047 |

TABLE 6B-continued

Genes significantly (p < 0.05) associated with cRFI or bRFI after adjustment for Gleason pattern in the primary Gleason pattern or highest Gleason pattern with hazard ration (HR) <1.0 (increased expression is positively associated with good prognosis)

| Table 6B Official Symbol | cRFI Primary Pattern HR | p-value | cRFI Highest Pattern HR | p-value | bRFI Primary Pattern HR | p-value | bRFI Highest Pattern HR | p-value |
|---|---|---|---|---|---|---|---|---|
| FASLG | | | 0.616 | 0.004 | | | 0.813 | 0.038 |
| FGF10 | 0.751 | 0.028 | | | 0.766 | 0.019 | | |
| FGF17 | | | 0.718 | 0.031 | 0.765 | 0.019 | | |
| FGFR2 | 0.740 | 0.009 | | | 0.738 | 0.002 | | |
| FKBP5 | | | 0.749 | 0.031 | | | | |
| FLNC | | | | | 0.826 | 0.029 | | |
| FLT1 | 0.779 | 0.045 | 0.729 | 0.006 | | | | |
| FLT4 | | | | | | | 0.815 | 0.024 |
| FOS | 0.657 | 0.003 | 0.656 | 0.004 | | | | |
| FSD1 | | | | | 0.763 | 0.017 | | |
| FYN | 0.716 | 0.004 | | | 0.792 | 0.024 | | |
| GADD45B | 0.692 | 0.009 | 0.697 | 0.010 | | | | |
| GDF15 | | | 0.767 | 0.016 | | | | |
| GHR | | | 0.701 | 0.002 | 0.704 | 0.002 | 0.640 | <.001 |
| GNRH1 | | | 0.778 | 0.039 | | | | |
| GPM6B | 0.749 | 0.010 | 0.750 | 0.010 | 0.827 | 0.037 | | |
| GRB7 | | | 0.696 | 0.005 | | | | |
| GSK3B | 0.726 | 0.005 | | | | | | |
| GSN | 0.660 | <.001 | 0.752 | 0.019 | | | | |
| GSTM1 | 0.710 | 0.004 | 0.676 | <.001 | | | | |
| GSTM2 | 0.643 | <.001 | | | 0.767 | 0.015 | | |
| HK1 | 0.798 | 0.035 | | | | | | |
| HLA-G | | | 0.660 | 0.013 | | | | |
| HLF | 0.644 | <.001 | 0.727 | 0.011 | | | | |
| HNF1B | | | 0.755 | 0.013 | | | | |
| HPS1 | 0.756 | 0.006 | 0.791 | 0.043 | | | | |
| HSD17B10 | 0.737 | 0.006 | | | | | | |
| HSD3B2 | | | | | | | 0.674 | 0.003 |
| HSP90AB1 | | | 0.763 | 0.015 | | | | |
| HSPB1 | 0.787 | 0.020 | 0.778 | 0.015 | | | | |
| HSPE1 | | | 0.794 | 0.039 | | | | |
| ICAM1 | | | 0.664 | 0.003 | | | | |
| IER3 | 0.699 | 0.003 | 0.693 | 0.010 | | | | |
| IFIT1 | 0.621 | <.001 | 0.733 | 0.027 | | | | |
| IGF1 | 0.751 | 0.017 | 0.655 | <.001 | | | | |
| IGFBP2 | 0.599 | <.001 | 0.605 | <.001 | | | | |
| IGFBP5 | 0.745 | 0.007 | 0.775 | 0.035 | | | | |
| IGFBP6 | 0.671 | 0.005 | | | | | | |
| IL1B | 0.732 | 0.016 | 0.717 | 0.005 | | | | |
| IL6 | 0.763 | 0.040 | | | | | | |
| IL6R | | | 0.764 | 0.022 | | | | |
| IL6ST | 0.647 | <.001 | 0.739 | 0.012 | | | | |
| IL8 | 0.711 | 0.015 | 0.694 | 0.006 | | | | |
| ING5 | 0.729 | 0.007 | 0.727 | 0.003 | | | | |
| ITGA4 | | | 0.755 | 0.009 | | | | |
| ITGA5 | 0.743 | 0.018 | 0.770 | 0.034 | | | | |
| ITGA6 | 0.816 | 0.044 | 0.772 | 0.006 | | | | |
| ITGA7 | 0.680 | 0.004 | | | | | | |
| ITGAD | | | 0.590 | 0.009 | | | | |
| ITGB4 | 0.663 | <.001 | 0.658 | <.001 | 0.759 | 0.004 | | |
| JUN | 0.656 | 0.004 | 0.639 | 0.003 | | | | |
| KIAA0196 | 0.737 | 0.011 | | | | | | |
| KIT | | | 0.730 | 0.021 | 0.724 | 0.008 | | |
| KLC1 | 0.755 | 0.035 | | | | | | |
| KLK1 | 0.706 | 0.008 | | | | | | |
| KLK2 | 0.740 | 0.016 | 0.723 | 0.001 | | | | |
| KLK3 | 0.765 | 0.006 | 0.740 | 0.002 | | | | |
| KRT1 | | | | | | | 0.774 | 0.042 |
| KRT15 | 0.658 | <.001 | 0.632 | <.001 | 0.764 | 0.008 | | |
| KRT18 | 0.703 | 0.004 | 0.672 | <.001 | 0.779 | 0.015 | 0.811 | 0.032 |
| KRT5 | 0.686 | <.001 | 0.629 | <.001 | 0.802 | 0.023 | | |
| KRT8 | 0.763 | 0.034 | 0.771 | 0.022 | | | | |
| L1CAM | 0.748 | 0.041 | | | | | | |
| LAG3 | 0.693 | 0.008 | 0.724 | 0.020 | | | | |
| LAMA4 | | | | | 0.689 | 0.039 | | |
| LAMB3 | 0.667 | <.001 | 0.645 | <.001 | 0.773 | 0.006 | | |
| LGALS3 | 0.666 | <.001 | | | 0.822 | 0.047 | | |
| LIG3 | | | 0.723 | 0.008 | | | | |
| LRP1 | 0.777 | 0.041 | | | | | 0.769 | 0.007 |
| MDM2 | | | 0.688 | <.001 | | | | |
| MET | 0.709 | 0.010 | 0.736 | 0.028 | 0.715 | 0.003 | | |
| MGMT | 0.751 | 0.031 | | | | | | |
| MICA | | | 0.705 | 0.002 | | | | |
| MPPED2 | 0.690 | 0.001 | 0.657 | <.001 | 0.708 | <.001 | | |
| MRC1 | | | | | | | 0.812 | 0.049 |
| MSH6 | | | | | | | 0.860 | 0.049 |
| MTSS1 | 0.686 | 0.001 | | | | | | |
| MVP | 0.798 | 0.034 | 0.761 | 0.033 | | | | |
| MYBPC1 | 0.754 | 0.009 | 0.615 | <.001 | | | | |
| NCAPD3 | 0.739 | 0.021 | 0.664 | 0.005 | | | | |
| NEXN | | | 0.798 | 0.037 | | | | |
| NFAT5 | 0.596 | <.001 | 0.732 | 0.005 | | | | |
| NFATC2 | 0.743 | 0.016 | 0.792 | 0.047 | | | | |
| NOS3 | 0.730 | 0.012 | 0.757 | 0.032 | | | | |
| OAZ1 | 0.732 | 0.020 | 0.705 | 0.002 | | | | |
| OCLN | | | | | 0.746 | 0.043 | 0.784 | 0.025 |
| OLFML3 | 0.711 | 0.002 | | | 0.709 | <.001 | 0.720 | 0.001 |
| OMD | 0.729 | 0.011 | 0.762 | 0.033 | | | | |
| OSM | | | | | | | 0.813 | 0.028 |
| PAGE4 | 0.668 | 0.003 | 0.725 | 0.004 | 0.688 | <.001 | 0.766 | 0.005 |
| PCA3 | 0.736 | 0.001 | 0.691 | <.001 | | | | |
| PCDHGB7 | | | | | 0.769 | 0.019 | 0.789 | 0.022 |
| PIK3CA | | | 0.768 | 0.010 | | | | |
| PIK3CG | 0.792 | 0.019 | 0.758 | 0.009 | | | | |
| PLG | | | | | | | 0.682 | 0.009 |
| PPAP2B | 0.688 | 0.005 | | | 0.815 | 0.046 | | |
| PPP1R12A | 0.731 | 0.026 | 0.775 | 0.042 | | | | |
| PRIMA1 | 0.697 | 0.004 | 0.757 | 0.032 | | | | |
| PRKCA | 0.743 | 0.019 | | | | | | |
| PRKCB | 0.756 | 0.036 | | | 0.767 | 0.029 | | |
| PROM1 | 0.640 | 0.027 | | | 0.699 | 0.034 | 0.503 | 0.013 |
| PTCH1 | 0.730 | 0.018 | | | | | | |
| PTEN | 0.779 | 0.015 | | | 0.789 | 0.007 | | |
| PTGS2 | 0.644 | <.001 | 0.703 | 0.007 | | | | |
| PTHLH | 0.655 | 0.012 | 0.706 | 0.038 | 0.634 | 0.001 | 0.665 | 0.003 |
| PTK2B | 0.779 | 0.023 | 0.702 | 0.002 | 0.806 | 0.015 | 0.806 | 0.024 |
| PYCARD | | | 0.659 | 0.001 | | | | |
| RAB30 | 0.779 | 0.033 | 0.754 | 0.014 | | | | |
| RARB | 0.787 | 0.043 | 0.742 | 0.009 | | | | |
| RASSF1 | 0.754 | 0.005 | | | | | | |
| RHOA | | | 0.796 | 0.041 | | | 0.819 | 0.048 |
| RND3 | 0.721 | 0.011 | 0.743 | 0.028 | | | | |
| SDC1 | | | 0.707 | 0.011 | | | | |
| SDC2 | | | | | 0.745 | 0.002 | | |
| SDHC | 0.750 | 0.013 | | | | | | |
| SERPINA3 | | | 0.730 | 0.016 | | | | |
| SERPINB5 | | | 0.715 | 0.041 | | | | |
| SH3RF2 | | | 0.698 | 0.025 | | | | |
| SIPA1L1 | | | 0.796 | 0.014 | | | 0.820 | 0.004 |
| SLC22A3 | 0.724 | 0.014 | 0.700 | 0.008 | | | | |
| SMAD4 | 0.668 | 0.002 | | | 0.771 | 0.016 | | |
| SMARCD1 | 0.726 | <.001 | 0.700 | 0.001 | | | 0.812 | 0.028 |
| SMO | | | | | | | 0.785 | 0.027 |
| SOD1 | | | 0.735 | 0.012 | | | | |
| SORBS1 | | | 0.785 | 0.039 | | | | |
| SPDEF | 0.818 | 0.002 | | | | | | |
| SPINT1 | 0.761 | 0.024 | 0.773 | 0.006 | | | | |
| SRC | 0.709 | <.001 | 0.690 | <.001 | | | | |
| SRD5A1 | 0.746 | 0.010 | 0.767 | 0.024 | 0.745 | 0.003 | | |
| SRD5A2 | 0.575 | <.001 | 0.669 | 0.001 | 0.674 | <.001 | 0.781 | 0.018 |
| ST5 | 0.774 | 0.027 | | | | | | |
| STAT1 | 0.694 | 0.004 | | | | | | |
| STAT5A | 0.719 | 0.004 | 0.765 | 0.006 | | | 0.834 | 0.049 |
| STAT5B | 0.704 | 0.001 | 0.744 | 0.012 | | | | |

TABLE 6B-continued

Genes significantly (p < 0.05) associated with cRFI or bRFI after adjustment for Gleason pattern in the primary Gleason pattern or highest Gleason pattern with hazard ration (HR) <1.0 (increased expression is positively associated with good prognosis)

| Table 6B Official Symbol | cRFI Primary Pattern HR | p-value | cRFI Highest Pattern HR | p-value | bRFI Primary Pattern HR | p-value | bRFI Highest Pattern HR | p-value |
|---|---|---|---|---|---|---|---|---|
| SUMO1 | 0.777 | 0.014 | | | | | | |
| SVIL | | | 0.771 | 0.026 | | | | |
| TBP | 0.774 | 0.031 | | | | | | |
| TFF3 | 0.742 | 0.015 | 0.719 | 0.024 | | | | |
| TGFB1I1 | 0.763 | 0.048 | | | | | | |
| TGFB2 | 0.729 | 0.011 | 0.758 | 0.002 | | | | |
| TMPRSS2 | 0.810 | 0.034 | 0.692 | <.001 | | | | |
| TNF | | | | | 0.727 | 0.022 | | |
| TNFRSF10A | | | 0.805 | 0.025 | | | | |
| TNFRSF10B | 0.581 | <.001 | 0.738 | 0.014 | 0.809 | 0.034 | | |
| TNFSF10 | 0.751 | 0.015 | 0.700 | <.001 | | | | |
| TP63 | | | 0.723 | 0.018 | 0.736 | 0.003 | | |
| TPM2 | 0.708 | 0.010 | 0.734 | 0.014 | | | | |
| TRAF3IP2 | | | 0.718 | 0.004 | | | | |
| TRO | | | 0.742 | 0.012 | | | | |
| TSTA3 | | | 0.774 | 0.028 | | | | |
| TUBB2A | 0.659 | <.001 | 0.650 | <.001 | | | | |
| TYMP | 0.695 | 0.002 | | | | | | |
| VCL | 0.683 | 0.008 | | | | | | |
| VIM | 0.778 | 0.040 | | | | | | |
| WDR19 | | | | | 0.775 | 0.014 | | |
| XRCC5 | 0.793 | 0.042 | | | | | | |
| YY1 | 0.751 | 0.025 | | | | | 0.810 | 0.008 |
| ZFHX3 | 0.760 | 0.005 | 0.726 | 0.001 | | | | |
| ZFP36 | 0.707 | 0.008 | 0.672 | 0.003 | | | | |
| ZNF827 | 0.667 | 0.002 | | | 0.792 | 0.039 | | |

Tables 7A and 7B provide genes significantly associated (p<0.05), positively or negatively, with clinical recurrence (cRFI) in negative TMPRSS fusion specimens in the primary or highest Gleason pattern specimen. Increased expression of genes in Table 7A is negatively associated with good prognosis, while increased expression of genes in Table 7B is positively associated with good prognosis.

TABLE 7A

Genes significantly (p < 0.05) associated with cRFI for TMPRSS2-ERG fusion negative in the primary Gleason pattern or highest Gleason pattern with hazard ratio (HR) > 1.0 (increased expression is negatively associated with good prognosis)

| Official Symbol | Primary Pattern HR | p-value | Highest Pattern HR | p-value |
|---|---|---|---|---|
| ANLN | 1.42 | 0.012 | 1.36 | 0.004 |
| AQP2 | 1.25 | 0.033 | | |
| ASPN | 2.48 | <.001 | 1.65 | <.001 |
| BGN | 2.04 | <.001 | 1.45 | 0.007 |
| BIRC5 | 1.59 | <.001 | 1.37 | 0.005 |
| BMP6 | 1.95 | <.001 | 1.43 | 0.012 |
| BMPR1B | 1.93 | 0.002 | | |
| BUB1 | 1.51 | <.001 | 1.35 | <.001 |
| CCNE2 | 1.48 | 0.007 | | |
| CD276 | 1.93 | <.001 | 1.79 | <.001 |
| CDC20 | 1.49 | 0.004 | 1.47 | <.001 |
| CDC6 | 1.52 | 0.009 | 1.34 | 0.022 |
| CDKN2B | 1.54 | 0.008 | 1.55 | 0.003 |
| CDKN2C | 1.55 | 0.003 | 1.57 | <.001 |
| CDKN3 | 1.34 | 0.026 | | |
| CENPF | 1.63 | 0.002 | 1.33 | 0.018 |
| CKS2 | 1.50 | 0.026 | 1.43 | 0.009 |
| CLTC | | | 1.46 | 0.014 |

TABLE 7A-continued

Genes significantly (p < 0.05) associated with cRFI for TMPRSS2-ERG fusion negative in the primary Gleason pattern or highest Gleason pattern with hazard ratio (HR) > 1.0 (increased expression is negatively associated with good prognosis)

| Official Symbol | Primary Pattern HR | p-value | Highest Pattern HR | p-value |
|---|---|---|---|---|
| COL1A1 | 1.98 | <.001 | 1.50 | 0.002 |
| COL3A1 | 2.03 | <.001 | 1.42 | 0.007 |
| COL4A1 | 1.81 | 0.002 | | |
| COL8A1 | 1.63 | 0.004 | 1.60 | 0.001 |
| CRISP3 | | | 1.31 | 0.016 |
| CTHRC1 | 1.67 | 0.006 | 1.48 | 0.005 |
| DDIT4 | 1.49 | 0.037 | | |
| ENY2 | | | 1.29 | 0.039 |
| EZH2 | | | 1.35 | 0.016 |
| F2R | 1.46 | 0.034 | 1.46 | 0.007 |
| FAP | 1.66 | 0.006 | 1.38 | 0.012 |
| FGF5 | | | 1.46 | 0.001 |
| GNPTAB | 1.49 | 0.013 | | |
| HSD17B4 | 1.34 | 0.039 | 1.44 | 0.002 |
| INHBA | 2.92 | <.001 | 2.19 | <.001 |
| JAG1 | 1.38 | 0.042 | | |
| KCNN2 | 1.71 | 0.002 | 1.73 | <.001 |
| KHDRBS3 | | | 1.46 | 0.015 |
| KLK14 | 1.28 | 0.034 | | |
| KPNA2 | 1.63 | 0.016 | | |
| LAMC1 | 1.41 | 0.044 | | |
| LOX | | | 1.29 | 0.036 |
| LTBP2 | 1.57 | 0.017 | | |
| MELK | 1.38 | 0.029 | | |
| MMP11 | 1.69 | 0.002 | 1.42 | 0.004 |
| MYBL2 | 1.78 | <.001 | 1.49 | <.001 |
| NETO2 | 2.01 | <.001 | 1.43 | 0.007 |
| NME1 | | | 1.38 | 0.017 |
| PATE1 | 1.43 | <.001 | 1.24 | 0.005 |
| PEX10 | 1.46 | 0.030 | | |
| PGD | 1.77 | 0.002 | | |
| POSTN | 1.49 | 0.037 | 1.34 | 0.026 |
| PPFIA3 | 1.51 | 0.012 | | |
| PPP3CA | 1.46 | 0.033 | 1.34 | 0.020 |
| PTK6 | 1.69 | <.001 | 1.56 | <.001 |
| PTTG1 | 1.35 | 0.028 | | |
| RAD51 | 1.32 | 0.048 | | |
| RALBP1 | | | 1.29 | 0.042 |
| RGS7 | 1.18 | 0.012 | 1.32 | 0.009 |
| RRM1 | 1.57 | 0.016 | 1.32 | 0.041 |
| RRM2 | 1.30 | 0.039 | | |
| SAT1 | 1.61 | 0.007 | | |
| SESN3 | 1.76 | <.001 | 1.36 | 0.020 |
| SFRP4 | 1.55 | 0.016 | 1.48 | 0.002 |
| SHMT2 | 2.23 | <.001 | 1.59 | <.001 |
| SPARC | 1.54 | 0.014 | | |
| SQLE | 1.86 | 0.003 | | |
| STMN1 | 2.14 | <.001 | | |
| THBS2 | 1.79 | <.001 | 1.43 | 0.009 |
| TK1 | 1.30 | 0.026 | | |
| TOP2A | 2.03 | <.001 | 1.47 | 0.003 |
| TPD52 | 1.63 | 0.003 | | |
| TPX2 | 2.11 | <.001 | 1.63 | <.001 |
| TRAP1 | 1.46 | 0.023 | | |
| UBE2C | 1.57 | <.001 | 1.58 | <.001 |
| UBE2G1 | 1.56 | 0.008 | | |
| UBE2T | 1.75 | <.001 | | |
| UGT2B15 | 1.31 | 0.036 | 1.33 | 0.004 |
| UHRF1 | 1.46 | 0.007 | | |
| UTP23 | 1.52 | 0.017 | | |

TABLE 7B

Genes significantly (p < 0.05) associated with cRFI for TMPRSS2-ERG fusion negative in the primary Gleason pattern or highest Gleason pattern with hazard ratio (HR) < 1.0 (increased expression is positively associated with good prognosis)

| Official Symbol | Primary Pattern HR | Primary Pattern p-value | Highest Pattern HR | Highest Pattern p-value |
|---|---|---|---|---|
| AAMP | 0.56 | <.001 | 0.65 | 0.001 |
| ABCA5 | 0.64 | <.001 | 0.71 | <.001 |
| ABCB1 | 0.62 | 0.004 | | |
| ABCC3 | | | 0.74 | 0.031 |
| ABCG2 | | | 0.78 | 0.050 |
| ABHD2 | 0.71 | 0.035 | | |
| ACOX2 | 0.54 | <.001 | 0.71 | 0.007 |
| ADH5 | 0.49 | <.001 | 0.61 | <.001 |
| AKAP1 | 0.77 | 0.031 | 0.76 | 0.013 |
| AKR1C1 | 0.65 | 0.006 | 0.78 | 0.044 |
| AKT1 | | | 0.72 | 0.020 |
| AKT3 | 0.75 | <.001 | | |
| ALDH1A2 | 0.53 | <.001 | 0.60 | <.001 |
| AMPD3 | 0.62 | <.001 | 0.78 | 0.028 |
| ANPEP | 0.54 | <.001 | 0.61 | <.001 |
| ANXA2 | 0.63 | 0.008 | 0.74 | 0.016 |
| ARHGAP29 | 0.67 | 0.005 | 0.77 | 0.016 |
| ARHGDIB | 0.64 | 0.013 | | |
| ATP5J | 0.57 | 0.050 | | |
| ATXN1 | 0.61 | 0.004 | 0.77 | 0.043 |
| AXIN2 | 0.51 | <.001 | 0.62 | <.001 |
| AZGP1 | 0.61 | <.001 | 0.64 | <.001 |
| BCL2 | 0.64 | 0.004 | 0.75 | 0.029 |
| BIN1 | 0.52 | <.001 | 0.74 | 0.010 |
| BTG3 | 0.75 | 0.032 | 0.75 | 0.010 |
| BTRC | 0.69 | 0.011 | | |
| C7 | 0.51 | <.001 | 0.67 | <.001 |
| CADM1 | 0.49 | <.001 | 0.76 | 0.034 |
| CASP1 | 0.71 | 0.010 | 0.74 | 0.007 |
| CAV1 | | | 0.73 | 0.015 |
| CCL5 | 0.67 | 0.018 | 0.67 | 0.003 |
| CCNH | 0.63 | <.001 | 0.75 | 0.004 |
| CCR1 | | | 0.77 | 0.032 |
| CD164 | 0.52 | <.001 | 0.63 | <.001 |
| CD44 | 0.53 | <.001 | 0.74 | 0.014 |
| CDH10 | 0.69 | 0.040 | | |
| CDH18 | 0.40 | 0.011 | | |
| CDK14 | 0.75 | 0.013 | | |
| CDK2 | | | 0.81 | 0.031 |
| CDK3 | 0.73 | 0.022 | | |
| CDKN1A | 0.68 | 0.038 | | |
| CDKN1C | 0.62 | 0.003 | 0.72 | 0.005 |
| COL6A1 | 0.54 | <.001 | 0.70 | 0.004 |
| COL6A3 | 0.64 | 0.004 | | |
| CSF1 | 0.56 | <.001 | 0.78 | 0.047 |
| CSRP1 | 0.40 | <.001 | 0.66 | 0.002 |
| CTGF | 0.66 | 0.015 | 0.74 | 0.027 |
| CTNNB1 | 0.69 | 0.043 | | |
| CTSB | 0.60 | 0.002 | 0.71 | 0.011 |
| CTSS | 0.67 | 0.013 | | |
| CXCL12 | 0.56 | <.001 | 0.77 | 0.026 |
| CYP3A5 | 0.43 | <.001 | 0.63 | <.001 |
| CYR61 | 0.43 | <.001 | 0.58 | <.001 |
| DAG1 | 0.72 | 0.012 | | |
| DARC | 0.66 | 0.016 | | |
| DDR2 | 0.65 | 0.007 | | |
| DES | 0.52 | <.001 | 0.74 | 0.018 |
| DHRS9 | 0.54 | 0.007 | | |
| DICER1 | 0.70 | 0.044 | | |
| DLC1 | | | 0.75 | 0.021 |
| DLGAP1 | 0.55 | <.001 | 0.72 | 0.005 |
| DNM3 | 0.61 | 0.001 | | |
| DPP4 | 0.55 | <.001 | 0.77 | 0.024 |
| DPT | 0.48 | <.001 | 0.61 | <.001 |
| DUSP1 | 0.47 | <.001 | 0.59 | <.001 |
| DUSP6 | 0.65 | 0.009 | 0.65 | 0.002 |
| DYNLL1 | | | 0.74 | 0.045 |
| EDNRA | 0.61 | 0.002 | 0.75 | 0.038 |
| EFNB2 | 0.71 | 0.043 | | |
| EGR1 | 0.43 | <.001 | 0.58 | <.001 |
| EGR3 | 0.47 | <.001 | 0.66 | <.001 |
| EIF5 | | | 0.77 | 0.028 |
| ELK4 | 0.49 | <.001 | 0.72 | 0.012 |
| EPHA2 | | | 0.70 | 0.007 |
| EPHA3 | 0.62 | <.001 | 0.72 | 0.009 |
| EPHB2 | 0.68 | 0.009 | | |
| ERBB2 | 0.64 | <.001 | 0.63 | <.001 |
| ERBB3 | 0.69 | 0.018 | | |
| ERCC1 | 0.69 | 0.019 | 0.77 | 0.021 |
| ESR2 | 0.61 | 0.020 | | |
| FAAH | 0.57 | <.001 | 0.77 | 0.035 |
| FABP5 | 0.67 | 0.035 | | |
| FAM107A | 0.42 | <.001 | 0.59 | <.001 |
| FAM13C | 0.53 | <.001 | 0.59 | <.001 |
| FAS | 0.71 | 0.035 | | |
| FASLG | 0.56 | 0.017 | 0.67 | 0.014 |
| FGF10 | 0.57 | 0.002 | | |
| FGF17 | 0.70 | 0.039 | 0.70 | 0.010 |
| FGF7 | 0.63 | 0.005 | 0.70 | 0.004 |
| FGFR2 | 0.63 | 0.003 | 0.71 | 0.003 |
| FKBP5 | | | 0.72 | 0.020 |
| FLNA | 0.48 | <.001 | 0.74 | 0.022 |
| FOS | 0.45 | <.001 | 0.56 | <.001 |
| FOXO1 | 0.59 | <.001 | | |
| FOXQ1 | 0.57 | <.001 | 0.69 | 0.008 |
| FYN | 0.62 | 0.001 | 0.74 | 0.013 |
| G6PD | | | 0.77 | 0.014 |
| GADD45A | 0.73 | 0.045 | | |
| GADD45B | 0.45 | <.001 | 0.64 | 0.001 |
| GDF15 | 0.58 | <.001 | | |
| GHR | 0.62 | 0.008 | 0.68 | 0.002 |
| GPM6B | 0.60 | <.001 | 0.70 | 0.003 |
| GSK3B | 0.71 | 0.016 | 0.71 | 0.006 |
| GSN | 0.46 | <.001 | 0.66 | <.001 |
| GSTM1 | 0.56 | <.001 | 0.62 | <.001 |
| GSTM2 | 0.47 | <.001 | 0.67 | <.001 |
| HGD | | | 0.72 | 0.002 |
| HIRIP3 | 0.69 | 0.021 | 0.69 | 0.002 |
| HK1 | 0.68 | 0.005 | 0.73 | 0.005 |
| HLA-G | 0.54 | 0.024 | 0.65 | 0.013 |
| HLF | 0.41 | <.001 | 0.68 | 0.001 |
| HNF1B | 0.55 | <.001 | 0.59 | <.001 |
| HPS1 | 0.74 | 0.015 | 0.76 | 0.025 |
| HSD17B3 | 0.65 | 0.031 | | |
| HSPB2 | 0.62 | 0.004 | 0.76 | 0.027 |
| ICAM1 | 0.61 | 0.010 | | |
| IER3 | 0.55 | <.001 | 0.67 | 0.003 |
| IFIT1 | 0.57 | <.001 | 0.70 | 0.008 |
| IFNG | | | 0.69 | 0.040 |
| IGF1 | 0.63 | <.001 | 0.59 | <.001 |
| IGF2 | 0.67 | 0.019 | 0.70 | 0.005 |
| IGFBP2 | 0.53 | <.001 | 0.63 | <.001 |
| IGFBP5 | 0.57 | <.001 | 0.71 | 0.006 |
| IGFBP6 | 0.41 | <.001 | 0.71 | 0.012 |
| IL10 | 0.59 | 0.020 | | |
| IL1B | 0.53 | <.001 | 0.70 | 0.005 |
| IL6 | 0.55 | 0.001 | | |
| IL6ST | 0.45 | <.001 | 0.68 | <.001 |
| IL8 | 0.60 | 0.005 | 0.70 | 0.008 |
| ILK | 0.68 | 0.029 | 0.76 | 0.036 |
| ING5 | 0.54 | <.001 | 0.82 | 0.033 |
| ITGA1 | 0.66 | 0.017 | | |
| ITGA3 | 0.70 | 0.020 | | |
| ITGA5 | 0.64 | 0.011 | | |
| ITGA6 | 0.66 | 0.003 | 0.74 | 0.006 |
| ITGA7 | 0.50 | <.001 | 0.71 | 0.010 |
| ITGB4 | 0.63 | 0.014 | 0.73 | 0.010 |
| ITPR1 | 0.55 | <.001 | | |
| ITPR3 | | | 0.76 | 0.007 |
| JUN | 0.37 | <.001 | 0.54 | <.001 |
| JUNB | 0.58 | 0.002 | 0.71 | 0.016 |
| KCTD12 | 0.68 | 0.017 | | |

TABLE 7B-continued

Genes significantly (p < 0.05) associated with cRFI for TMPRSS2-ERG fusion negative in the primary Gleason pattern or highest Gleason pattern with hazard ratio (HR) < 1.0 (increased expression is positively associated with good prognosis)

| Official Symbol | Primary Pattern | | Highest Pattern | |
|---|---|---|---|---|
| | HR | p-value | HR | p-value |
| KIT | 0.49 | 0.002 | 0.76 | 0.043 |
| KLC1 | 0.61 | 0.005 | 0.77 | 0.045 |
| KLF6 | 0.65 | 0.009 | | |
| KLK1 | 0.68 | 0.036 | | |
| KLK10 | | | 0.76 | 0.037 |
| KLK2 | 0.64 | <.001 | 0.73 | 0.006 |
| KLK3 | 0.65 | <.001 | 0.76 | 0.021 |
| KLRK1 | 0.63 | 0.005 | | |
| KRT15 | 0.52 | <.001 | 0.58 | <.001 |
| KRT18 | 0.46 | <.001 | | |
| KRT5 | 0.51 | <.001 | 0.58 | <.001 |
| KRT8 | 0.53 | <.001 | | |
| L1CAM | 0.65 | 0.031 | | |
| LAG3 | 0.58 | 0.002 | 0.76 | 0.033 |
| LAMA4 | 0.52 | 0.018 | | |
| LAMB3 | 0.60 | 0.002 | 0.65 | 0.003 |
| LGALS3 | 0.52 | <.001 | 0.71 | 0.002 |
| LIG3 | 0.65 | 0.011 | | |
| LRP1 | 0.61 | 0.001 | 0.75 | 0.040 |
| MGMT | 0.66 | 0.003 | | |
| MICA | 0.59 | 0.001 | 0.68 | 0.001 |
| MLXIP | 0.70 | 0.020 | | |
| MMP2 | 0.68 | 0.022 | | |
| MMP9 | 0.67 | 0.036 | | |
| MPPED2 | 0.57 | <.001 | 0.66 | <.001 |
| MRC1 | 0.69 | 0.028 | | |
| MTSS1 | 0.63 | 0.005 | 0.79 | 0.037 |
| MVP | 0.62 | <.001 | | |
| MYBPC1 | 0.53 | <.001 | 0.70 | 0.011 |
| NCAM1 | 0.70 | 0.039 | 0.77 | 0.042 |
| NCAPD3 | 0.52 | <.001 | 0.59 | <.001 |
| NDRG1 | | | 0.69 | 0.008 |
| NEXN | 0.62 | 0.002 | | |
| NFAT5 | 0.45 | <.001 | 0.59 | <.001 |
| NFATC2 | 0.68 | 0.035 | 0.75 | 0.036 |
| NFKBIA | 0.70 | 0.030 | | |
| NRG1 | 0.59 | 0.022 | 0.71 | 0.018 |
| OAZ1 | 0.69 | 0.018 | 0.62 | <.001 |
| OLFML3 | 0.59 | <.001 | 0.72 | 0.003 |
| OR51E2 | 0.73 | 0.013 | | |
| PAGE4 | 0.42 | <.001 | 0.62 | <.001 |
| PCA3 | 0.53 | <.001 | | |
| PCDHGB7 | 0.70 | 0.032 | | |
| PGF | 0.68 | 0.027 | 0.71 | 0.013 |
| PGR | | | 0.76 | 0.041 |
| PIK3C2A | | | 0.80 | <.001 |
| PIK3CA | 0.61 | <.001 | 0.80 | 0.036 |
| PIK3CG | 0.67 | 0.001 | 0.76 | 0.018 |
| PLP2 | 0.65 | 0.015 | 0.72 | 0.010 |
| PPAP2B | 0.45 | <.001 | 0.69 | 0.003 |
| PPP1R12A | 0.61 | 0.007 | 0.73 | 0.017 |
| PRIMAL | 0.51 | <.001 | 0.68 | 0.004 |
| PRKCA | 0.55 | <.001 | 0.74 | 0.009 |
| PRKCB | 0.55 | <.001 | | |
| PROM1 | | | 0.67 | 0.042 |
| PROS 1 | 0.73 | 0.036 | | |
| PTCH1 | 0.69 | 0.024 | 0.72 | 0.010 |
| PTEN | 0.54 | <.001 | 0.64 | <.001 |
| PTGS 2 | 0.48 | <.001 | 0.55 | <.001 |
| PTH1R | 0.57 | 0.003 | 0.77 | 0.050 |
| PTHLH | 0.55 | 0.010 | | |
| PTK2B | 0.56 | <.001 | 0.70 | 0.001 |
| PYCARD | | | 0.73 | 0.009 |
| RAB27A | 0.65 | 0.009 | 0.71 | 0.014 |
| RAB30 | 0.59 | 0.003 | 0.72 | 0.010 |
| RAGE | | | 0.76 | 0.011 |
| RARB | 0.59 | <.001 | 0.63 | <.001 |
| RASSF1 | 0.67 | 0.003 | | |
| RB1 | 0.67 | 0.006 | | |
| RFX1 | 0.71 | 0.040 | 0.70 | 0.003 |
| RHOA | 0.71 | 0.038 | 0.65 | <.001 |
| RHOB | 0.58 | 0.001 | 0.71 | 0.006 |
| RND3 | 0.54 | <.001 | 0.69 | 0.003 |
| RNF114 | 0.59 | 0.004 | 0.68 | 0.003 |
| SCUBE2 | | | 0.77 | 0.046 |
| SDHC | 0.72 | 0.028 | 0.76 | 0.025 |
| SEC23A | | | 0.75 | 0.029 |
| SEMA3A | 0.61 | 0.004 | 0.72 | 0.011 |
| SEPT9 | 0.66 | 0.013 | 0.76 | 0.036 |
| SERPINB5 | | | 0.75 | 0.039 |
| SH3RF2 | 0.44 | <.001 | 0.48 | <.001 |
| SHH | | | 0.74 | 0.049 |
| SLC22A3 | 0.42 | <.001 | 0.61 | <.001 |
| SMAD4 | 0.45 | <.001 | 0.66 | <.001 |
| SMARCD1 | 0.69 | 0.016 | | |
| SOD1 | 0.68 | 0.042 | | |
| SORBS1 | 0.51 | <.001 | 0.73 | 0.012 |
| SPARCL1 | 0.58 | <.001 | 0.77 | 0.040 |
| SPDEF | 0.77 | <.001 | | |
| SPINT1 | 0.65 | 0.004 | 0.79 | 0.038 |
| SRC | 0.61 | <.001 | 0.69 | 0.001 |
| SRD5A2 | 0.39 | <.001 | 0.55 | <.001 |
| ST5 | 0.61 | <.001 | 0.73 | 0.012 |
| STAT1 | 0.64 | 0.006 | | |
| STAT3 | 0.63 | 0.010 | | |
| STAT5A | 0.62 | 0.001 | 0.70 | 0.003 |
| STAT5B | 0.58 | <.001 | 0.73 | 0.009 |
| SUMO1 | 0.66 | <.001 | | |
| SVIL | 0.57 | 0.001 | 0.74 | 0.022 |
| TBP | 0.65 | 0.002 | | |
| TFF1 | 0.65 | 0.021 | | |
| TFF3 | 0.58 | <.001 | | |
| TGFB1I1 | 0.51 | <.001 | 0.75 | 0.026 |
| TGFB2 | 0.48 | <.001 | 0.62 | <.001 |
| TGFBR2 | 0.61 | 0.003 | | |
| TIAM1 | 0.68 | 0.019 | | |
| TIMP2 | 0.69 | 0.020 | | |
| TIMP3 | 0.58 | 0.002 | | |
| TNFRSF10A | 0.73 | 0.047 | | |
| TNFRSF10B | 0.47 | <.001 | 0.70 | 0.003 |
| TNFSF10 | 0.56 | 0.001 | | |
| TP63 | | | 0.67 | 0.001 |
| TPM1 | 0.58 | 0.004 | 0.73 | 0.017 |
| TPM2 | 0.46 | <.001 | 0.70 | 0.005 |
| TRA2A | 0.68 | 0.013 | | |
| TRAF3IP2 | 0.73 | 0.041 | 0.71 | 0.004 |
| TRO | 0.72 | 0.016 | 0.71 | 0.004 |
| TUBB2A | 0.53 | <.001 | 0.73 | 0.021 |
| TYMP | 0.70 | 0.011 | | |
| VCAM1 | 0.69 | 0.041 | | |
| VCL | 0.46 | <.001 | | |
| VEGFA | | | 0.77 | 0.039 |
| VEGFB | 0.71 | 0.035 | | |
| VIM | 0.60 | 0.001 | | |
| XRCC5 | | | 0.75 | 0.026 |
| YY1 | 0.62 | 0.008 | 0.77 | 0.039 |
| ZFHX3 | 0.53 | <.001 | 0.58 | <.001 |
| ZFP36 | 0.43 | <.001 | 0.54 | <.001 |
| ZNF827 | 0.55 | 0.001 | | |

Tables 8A and 8B provide genes that were significantly associated (p<0.05), positively or negatively, with clinical recurrence (cRFI) in positive TMPRSS fusion specimens in the primary or highest Gleason pattern specimen. Increased expression of genes in Table 8A is negatively associated with good prognosis, while increased expression of genes in Table 8B is positively associated with good prognosis.

TABLE 8A

Genes significantly (p < 0.05) associated with cRFI for TMPRSS2-ERG fusion positive in the primary Gleason pattern or highest Gleason pattern with hazard ratio (HR) > 1.0 (increased expression is negatively associated with good prognosis)

| Official Symbol | Primary Pattern HR | Primary Pattern p-value | Highest Pattern HR | Highest Pattern p-value |
|---|---|---|---|---|
| ACTR2 | 1.78 | 0.017 | | |
| AKR1C3 | 1.44 | 0.013 | | |
| ALCAM | | | 1.44 | 0.022 |
| ANLN | 1.37 | 0.046 | 1.81 | <.001 |
| APOE | 1.49 | 0.023 | 1.66 | 0.005 |
| AQP2 | | | 1.30 | 0.013 |
| ARHGDIB | 1.55 | 0.021 | | |
| ASPN | 2.13 | <.001 | 2.43 | <.001 |
| ATP5E | 1.69 | 0.013 | 1.58 | 0.014 |
| BGN | 1.92 | <.001 | 2.55 | <.001 |
| BIRC5 | 1.48 | 0.006 | 1.89 | <.001 |
| BMP6 | 1.51 | 0.010 | 1.96 | <.001 |
| BRCA2 | | | 1.41 | 0.007 |
| BUB1 | 1.36 | 0.007 | 1.52 | <.001 |
| CCNE2 | 1.55 | 0.004 | 1.59 | <.001 |
| CD276 | | | 1.65 | <.001 |
| CDC20 | 1.68 | <.001 | 1.74 | <.001 |
| CDH11 | | | 1.50 | 0.017 |
| CDH18 | 1.36 | <.001 | | |
| CDH7 | 1.54 | 0.009 | 1.46 | 0.026 |
| CDKN2B | 1.68 | 0.008 | 1.93 | 0.001 |
| CDKN2C | 2.01 | <.001 | 1.77 | <.001 |
| CDKN3 | 1.51 | 0.002 | 1.33 | 0.049 |
| CENPF | 1.51 | 0.007 | 2.04 | <.001 |
| CKS2 | 1.43 | 0.034 | 1.56 | 0.007 |
| COL1A1 | 2.23 | <.001 | 3.04 | <.001 |
| COL1A2 | 1.79 | 0.001 | 2.22 | <.001 |
| COL3A1 | 1.96 | <.001 | 2.81 | <.001 |
| COL4A1 | | | 1.52 | 0.020 |
| COL5A1 | | | 1.50 | 0.020 |
| COL5A2 | 1.64 | 0.017 | 1.55 | 0.010 |
| COL8A1 | 1.96 | <.001 | 2.38 | <.001 |
| CRISP3 | 1.68 | 0.002 | 1.67 | 0.002 |
| CTHRC1 | | | 2.06 | <.001 |
| CTNND2 | 1.42 | 0.046 | 1.50 | 0.025 |
| CTSK | | | 1.43 | 0.049 |
| CXCR4 | 1.82 | 0.001 | 1.64 | 0.007 |
| DDIT4 | 1.54 | 0.016 | 1.58 | 0.009 |
| DLL4 | | | 1.51 | 0.007 |
| DYNLL1 | 1.50 | 0.021 | 1.22 | 0.002 |
| F2R | 2.27 | <.001 | 2.02 | <.001 |
| FAP | | | 2.12 | <.001 |
| FCGR3A | | | 1.94 | 0.002 |
| FGF5 | 1.23 | 0.047 | | |
| FOXP3 | 1.52 | 0.006 | 1.48 | 0.018 |
| GNPTAB | | | 1.44 | 0.042 |
| GPR68 | | | 1.51 | 0.011 |
| GREM1 | 1.91 | <.001 | 2.38 | <.001 |
| HDAC1 | | | 1.43 | 0.048 |
| HDAC9 | 1.65 | <.001 | 1.67 | 0.004 |
| HRAS | 1.65 | 0.005 | 1.58 | 0.021 |
| IGFBP3 | 1.94 | <.001 | 1.85 | <.001 |
| INHBA | 2.03 | <.001 | 2.64 | <.001 |
| JAG1 | 1.41 | 0.027 | 1.50 | 0.008 |
| KCTD12 | | | 1.51 | 0.017 |
| KHDRBS3 | 1.48 | 0.029 | 1.54 | 0.014 |
| KPNA2 | | | 1.46 | 0.050 |
| LAMA3 | 1.35 | 0.040 | | |
| LAMC1 | 1.77 | 0.012 | | |
| LTBP2 | | | 1.82 | <.001 |
| LUM | 1.51 | 0.021 | 1.53 | 0.009 |
| MELK | 1.38 | 0.020 | 1.49 | 0.001 |
| MKI67 | | | 1.37 | 0.014 |
| MMP11 | 1.73 | <.001 | 1.69 | <.001 |
| MRPL13 | | | 1.30 | 0.046 |
| MYBL2 | 1.56 | <.001 | 1.72 | <.001 |
| MYLK3 | | | 1.17 | 0.007 |
| NOX4 | 1.58 | 0.005 | 1.96 | <.001 |
| NRIP3 | | | 1.30 | 0.040 |
| NRP1 | | | 1.53 | 0.021 |
| OLFML2B | | | 1.54 | 0.024 |
| OSM | 1.43 | 0.018 | | |
| PATE1 | 1.20 | <.001 | 1.33 | <.001 |
| PCNA | | | 1.64 | 0.003 |
| PEX10 | 1.41 | 0.041 | 1.64 | 0.003 |
| PIK3CA | 1.38 | 0.037 | | |
| PLK1 | 1.52 | 0.009 | 1.67 | 0.002 |
| PLOD2 | | | 1.65 | 0.002 |
| POSTN | 1.79 | <.001 | 2.06 | <.001 |
| PTK6 | 1.67 | 0.002 | 2.38 | <.001 |
| PTTG1 | 1.56 | 0.002 | 1.54 | 0.003 |
| RAD21 | 1.61 | 0.036 | 1.53 | 0.005 |
| RAD51 | | | 1.33 | 0.009 |
| RALA | 1.95 | 0.004 | 1.60 | 0.007 |
| REG4 | | | 1.43 | 0.042 |
| ROBO2 | 1.46 | 0.024 | | |
| RRM1 | | | 1.44 | 0.033 |
| RRM2 | | | 1.50 | 0.003 | 
| | | | 1.48 | <.001 |
| SAT1 | 1.42 | 0.009 | 1.43 | 0.012 |
| SEC14L1 | | | 1.64 | 0.002 |
| SFRP4 | 2.07 | <.001 | 2.40 | <.001 |
| SHMT2 | 1.52 | 0.030 | 1.60 | 0.001 |
| SLC44A1 | | | 1.42 | 0.039 |
| SPARC | 1.93 | <.001 | 2.21 | <.001 |
| SULF1 | 1.63 | 0.006 | 2.04 | <.001 |
| THBS2 | 1.95 | <.001 | 2.26 | <.001 |
| THY1 | 1.69 | 0.016 | 1.95 | 0.002 |
| TK1 | | | 1.43 | 0.003 |
| TOP2A | 1.57 | 0.002 | 2.11 | <.001 |
| TPX2 | 1.84 | <.001 | 2.27 | <.001 |
| UBE2C | 1.41 | 0.011 | 1.44 | 0.006 |
| UBE2T | 1.63 | 0.001 | | |
| UHRF1 | 1.51 | 0.007 | 1.69 | <.001 |
| WISP1 | 1.47 | 0.045 | | |
| WNT5A | 1.35 | 0.027 | 1.63 | 0.001 |
| ZWINT | 1.36 | 0.045 | | |

TABLE 8B

Genes significantly (p < 0.05) associated with cRFI for TMPRSS2-ERG fusion positive in the primary Gleason pattern or highest Gleason pattern with hazard ratio (HR) < 1.0 (increased expression is positively associated with good prognosis)

| Official Symbol | Primary Pattern HR | Primary Pattern p-value | Highest Pattern HR | Highest Pattern p-value |
|---|---|---|---|---|
| AAMP | 0.57 | 0.007 | 0.58 | <.001 |
| ABCA5 | | | 0.80 | 0.044 |
| ACE | 0.65 | 0.023 | 0.55 | <.001 |
| ACOX2 | | | 0.55 | <.001 |
| ADH5 | | | 0.68 | 0.022 |
| AKAP1 | | | 0.81 | 0.043 |
| ALDH1A2 | 0.72 | 0.036 | 0.43 | <.001 |
| ANPEP | 0.66 | 0.022 | 0.46 | <.001 |
| APRT | | | 0.73 | 0.040 |
| AXIN2 | | | 0.60 | <.001 |
| AZGP1 | 0.57 | <.001 | 0.65 | <.001 |
| BCL2 | | | 0.69 | 0.035 |
| BIK | 0.71 | 0.045 | | |
| BIN1 | 0.71 | 0.004 | 0.71 | 0.009 |
| BTRC | 0.66 | 0.003 | 0.58 | <.001 |
| C7 | | | 0.64 | 0.006 |
| CADM1 | 0.61 | <.001 | 0.47 | <.001 |
| CCL2 | | | 0.73 | 0.042 |
| CCNH | 0.69 | 0.022 | | |
| CD44 | 0.56 | <.001 | 0.58 | <.001 |
| CD82 | | | 0.72 | 0.033 |

TABLE 8B-continued

Genes significantly (p < 0.05) associated with cRFI for TMPRSS2-ERG fusion positive in the primary Gleason pattern or highest Gleason pattern with hazard ratio (HR) < 1.0 (increased expression is positively associated with good prognosis)

| | Primary Pattern | | Highest Pattern | |
|---|---|---|---|---|
| Official Symbol | HR | p-value | HR | p-value |
| CDC25B | 0.74 | 0.028 | | |
| CDH1 | 0.75 | 0.030 | 0.72 | 0.010 |
| CDH19 | | | 0.56 | 0.015 |
| CDK3 | | | 0.78 | 0.045 |
| CDKN1C | 0.74 | 0.045 | 0.70 | 0.014 |
| CSF1 | | | 0.72 | 0.037 |
| CTSB | | | 0.69 | 0.048 |
| CTSL2 | | | 0.58 | 0.005 |
| CYP3A5 | 0.51 | <.001 | 0.30 | <.001 |
| DHX9 | 0.89 | 0.006 | 0.87 | 0.012 |
| DLC1 | | | 0.64 | 0.023 |
| DLGAP1 | 0.69 | 0.010 | 0.49 | <.001 |
| DPP4 | 0.64 | <.001 | 0.56 | <.001 |
| DPT | | | 0.63 | 0.003 |
| EGR1 | | | 0.69 | 0.035 |
| EGR3 | | | 0.68 | 0.025 |
| EIF2S3 | 0.70 | 0.021 | | |
| EIF5 | 0.71 | 0.030 | | |
| ELK4 | 0.71 | 0.041 | 0.60 | 0.003 |
| EPHA2 | 0.72 | 0.036 | 0.66 | 0.011 |
| EPHB4 | | | 0.65 | 0.007 |
| ERCC1 | | | 0.68 | 0.023 |
| ESR2 | | | 0.64 | 0.027 |
| FAM107A | 0.64 | 0.003 | 0.61 | 0.003 |
| FAM13C | 0.68 | 0.006 | 0.55 | <.001 |
| FGFR2 | 0.73 | 0.033 | 0.59 | <.001 |
| FKBP5 | | | 0.60 | 0.006 |
| FLNC | 0.68 | 0.024 | 0.65 | 0.012 |
| FLT1 | | | 0.71 | 0.027 |
| FOS | | | 0.62 | 0.006 |
| FOXO1 | | | 0.75 | 0.010 |
| GADD45B | | | 0.68 | 0.020 |
| GHR | | | 0.62 | 0.006 |
| GPM6B | | | 0.57 | <.001 |
| GSTM1 | 0.68 | 0.015 | 0.58 | <.001 |
| GSTM2 | 0.65 | 0.005 | 0.47 | <.001 |
| HGD | 0.63 | 0.001 | 0.71 | 0.020 |
| HK1 | 0.67 | 0.003 | 0.62 | 0.002 |
| HLF | | | 0.59 | <.001 |
| HNF1B | 0.66 | 0.004 | 0.61 | 0.001 |
| IER3 | | | 0.70 | 0.026 |
| IGF1 | 0.63 | 0.005 | 0.55 | <.001 |
| IGF1R | | | 0.76 | 0.049 |
| IGFBP2 | 0.59 | 0.007 | 0.64 | 0.003 |
| IL6ST | | | 0.65 | 0.005 |
| IL8 | 0.61 | 0.005 | 0.66 | 0.019 |
| ILK | | | 0.64 | 0.015 |
| ING5 | 0.73 | 0.033 | 0.70 | 0.009 |
| ITGA7 | 0.72 | 0.045 | 0.69 | 0.019 |
| ITGB4 | | | 0.63 | 0.002 |
| KLC1 | | | 0.74 | 0.045 |
| KLK1 | 0.56 | 0.002 | 0.49 | <.001 |
| KLK10 | | | 0.68 | 0.013 |
| KLK11 | | | 0.66 | 0.003 |
| KLK2 | 0.66 | 0.045 | 0.65 | 0.011 |
| KLK3 | 0.75 | 0.048 | 0.77 | 0.014 |
| KRT15 | 0.71 | 0.017 | 0.50 | <.001 |
| KRT5 | 0.73 | 0.031 | 0.54 | <.001 |
| LAMA5 | | | 0.70 | 0.044 |
| LAMB3 | 0.70 | 0.005 | 0.58 | <.001 |
| LGALS3 | | | 0.69 | 0.025 |
| LIG3 | | | 0.68 | 0.022 |
| MDK | 0.69 | 0.035 | | |
| MGMT | 0.59 | 0.017 | 0.60 | <.001 |
| MGST1 | | | 0.73 | 0.042 |
| MICA | | | 0.70 | 0.009 |
| MPPED2 | 0.72 | 0.031 | 0.54 | <.001 |
| MTSS1 | 0.62 | 0.003 | | |
| MYBPC1 | | | 0.50 | <.001 |
| NCAPD3 | 0.62 | 0.007 | 0.38 | <.001 |
| NCOR1 | | | 0.82 | 0.048 |
| NFAT5 | 0.60 | 0.001 | 0.62 | <.001 |
| NRG1 | 0.66 | 0.040 | 0.61 | 0.029 |
| NUP62 | 0.75 | 0.037 | | |
| OMD | 0.54 | <.001 | | |
| PAGE4 | | | 0.64 | 0.005 |
| PCA3 | | | 0.66 | 0.012 |
| PCDHGB7 | | | 0.68 | 0.018 |
| PGR | | | 0.60 | 0.012 |
| PPAP2B | 0.62 | 0.010 | | |
| PPP1R12A | 0.73 | 0.031 | 0.58 | 0.003 |
| PRIMA1 | | | 0.65 | 0.013 |
| PROM1 | 0.41 | 0.013 | | |
| PTCH1 | 0.64 | 0.006 | | |
| PTEN | | | 0.75 | 0.047 |
| PTGS2 | | | 0.67 | 0.011 |
| PTK2B | | | 0.66 | 0.005 |
| PTPN1 | | | 0.71 | 0.026 |
| RAGE | 0.70 | 0.012 | | |
| RARB | | | 0.68 | 0.016 |
| RGS10 | | | 0.84 | 0.034 |
| RHOB | | | 0.66 | 0.016 |
| RND3 | | | 0.63 | 0.004 |
| SDHC | 0.73 | 0.044 | 0.69 | 0.016 |
| SERPINA3 | 0.67 | 0.011 | 0.51 | <.001 |
| SERPINB5 | | | 0.42 | <.001 |
| SH3RF2 | 0.66 | 0.012 | 0.51 | <.001 |
| SLC22A3 | 0.59 | 0.003 | 0.48 | <.001 |
| SMAD4 | 0.64 | 0.004 | 0.49 | <.001 |
| SMARCC2 | | | 0.73 | 0.042 |
| SMARCD1 | 0.73 | <.001 | 0.76 | 0.035 |
| SMO | | | 0.64 | 0.006 |
| SNAI1 | | | 0.53 | 0.008 |
| SOD1 | | | 0.60 | 0.003 |
| SRC | 0.64 | <.001 | 0.61 | <.001 |
| SRD5A2 | 0.63 | 0.004 | 0.59 | <.001 |
| STAT3 | | | 0.64 | 0.014 |
| STAT5A | | | 0.70 | 0.032 |
| STAT5B | 0.74 | 0.034 | 0.63 | 0.003 |
| SVIL | | | 0.71 | 0.028 |
| TGFB1I1 | | | 0.68 | 0.036 |
| TMPRSS2 | 0.72 | 0.015 | 0.67 | <.001 |
| TNFRSF10A | | | 0.69 | 0.010 |
| TNFRSF10B | 0.67 | 0.007 | 0.64 | 0.001 |
| TNFRSF18 | 0.38 | 0.003 | | |
| TNFSF10 | | | 0.71 | 0.025 |
| TP53 | 0.68 | 0.004 | 0.57 | <.001 |
| TP63 | 0.75 | 0.049 | 0.52 | <.001 |
| TPM2 | | | 0.62 | 0.007 |
| TRAF3IP2 | 0.71 | 0.017 | 0.68 | 0.005 |
| TRO | | | 0.72 | 0.033 |
| TUBB2A | | | 0.69 | 0.038 |
| VCL | | | 0.62 | <.001 |
| VEGFA | | | 0.71 | 0.037 |
| WWOX | | | 0.65 | 0.004 |
| ZFHX3 | 0.77 | 0.011 | 0.73 | 0.012 |
| ZFP36 | | | 0.69 | 0.018 |
| ZNF827 | 0.68 | 0.013 | 0.49 | <.001 |

Tables 9A and 9B provide genes significantly associated (p<0.05), positively or negatively, with TMPRSS fusion status in the primary Gleason pattern. Increased expression of genes in Table 9A are positively associated with TMPRSS fusion positivity, while increased expression of genes in Table 10A are negatively associated with TMPRSS fusion positivity.

TABLE 9A

Genes significantly (p < 0.05) associated with TMPRSS fusion status in the primary Gleason pattern with odds ratio (OR) > 1.0 (increased expression is positively associated with TMPRSS fusion positivity

| Official Symbol | p-value | Odds Ratio |
|---|---|---|
| ABCC8 | <.001 | 1.86 |
| ALDH18A1 | 0.005 | 1.49 |
| ALKBH3 | 0.043 | 1.30 |
| ALOX5 | <.001 | 1.66 |
| AMPD3 | <.001 | 3.92 |
| APEX1 | <.001 | 2.00 |
| ARHGDIB | <.001 | 1.87 |
| ASAP2 | 0.019 | 1.48 |
| ATXN1 | 0.013 | 1.41 |
| BMPR1B | <.001 | 2.37 |
| CACNA1D | <.001 | 9.01 |
| CADPS | 0.015 | 1.39 |
| CD276 | 0.003 | 2.25 |
| CDH1 | 0.016 | 1.37 |
| CDH7 | <.001 | 2.22 |
| CDK7 | 0.025 | 1.43 |
| COL9A2 | <.001 | 2.58 |
| CRISP3 | <.001 | 2.60 |
| CTNND1 | 0.033 | 1.48 |
| ECE1 | <.001 | 2.22 |
| EIF5 | 0.023 | 1.34 |
| EPHB4 | 0.005 | 1.51 |
| ERG | <.001 | 14.5 |
| FAM171B | 0.047 | 1.32 |
| FAM73A | 0.008 | 1.45 |
| FASN | 0.004 | 1.50 |
| GNPTAB | <.001 | 1.60 |
| GPS1 | 0.006 | 1.45 |
| GRB7 | 0.023 | 1.38 |
| HDAC1 | <.001 | 4.95 |
| HGD | <.001 | 1.64 |
| HIP1 | <.001 | 1.90 |
| HNF1B | <.001 | 3.55 |
| HSPA8 | 0.041 | 1.32 |
| IGF1R | 0.001 | 1.73 |
| ILF3 | <.001 | 1.91 |
| IMMT | 0.025 | 1.36 |
| ITPR1 | <.001 | 2.72 |
| ITPR3 | <.001 | 5.91 |
| JAG1 | 0.007 | 1.42 |
| KCNN2 | <.001 | 2.80 |
| KHDRBS3 | <.001 | 2.63 |
| KIAA0247 | 0.019 | 1.38 |
| KLK11 | <.001 | 1.98 |
| LAMC1 | 0.008 | 1.56 |
| LAMC2 | <.001 | 3.30 |
| LOX | 0.009 | 1.41 |
| LRP1 | 0.044 | 1.30 |
| MAP3K5 | <.001 | 2.06 |
| MAP7 | <.001 | 2.74 |
| MSH2 | 0.005 | 1.59 |
| MSH3 | 0.006 | 1.45 |
| MUC1 | 0.012 | 1.42 |
| MYO6 | <.001 | 3.79 |
| NCOR2 | 0.001 | 1.62 |
| NDRG1 | <.001 | 6.77 |
| NETO2 | <.001 | 2.63 |
| ODC1 | <.001 | 1.98 |
| OR51E1 | <.001 | 2.24 |
| PDE9A | <.001 | 2.21 |
| PEX10 | <.001 | 3.41 |
| PGK1 | 0.022 | 1.33 |
| PLA2G7 | <.001 | 5.51 |
| PPP3CA | 0.047 | 1.38 |
| PSCA | 0.013 | 1.43 |
| PSMD13 | 0.004 | 1.51 |
| PTCH1 | 0.022 | 1.38 |
| PTK2 | 0.014 | 1.38 |
| PTK6 | <.001 | 2.29 |
| PTK7 | <.001 | 2.45 |
| PTPRK | <.001 | 1.80 |
| RAB30 | 0.001 | 1.60 |
| REG4 | 0.018 | 1.58 |
| RELA | 0.001 | 1.62 |
| RFX1 | 0.020 | 1.43 |
| RGS10 | <.001 | 1.71 |
| SCUBE2 | 0.009 | 1.48 |
| SEPT9 | <.001 | 3.91 |
| SH3RF2 | 0.004 | 1.48 |
| SH3YL1 | <.001 | 1.87 |
| SHH | <.001 | 2.45 |
| SIM2 | <.001 | 1.74 |
| SIPA1L1 | 0.021 | 1.35 |
| SLC22A3 | <.001 | 1.63 |
| SLC44A1 | <.001 | 1.65 |
| SPINT1 | 0.017 | 1.39 |
| TFDP1 | 0.005 | 1.75 |
| TMPRSS2ERGA | 0.002 | 14E5 |
| TMPRSS2ERGB | <.001 | 1.97 |
| TRIM14 | <.001 | 1.65 |
| TSTA3 | 0.018 | 1.38 |
| UAP1 | 0.046 | 1.39 |
| UBE2G1 | 0.001 | 1.66 |
| UGDH | <.001 | 2.22 |
| XRCC5 | <.001 | 1.66 |
| ZMYND8 | <.001 | 2.19 |

TABLE 9B

Genes significantly (p < 0.05) associated with TMPRSS fusion status in the primary Gleason pattern with odds ratio (OR) < 1.0 (increased expression is negatively associated with TMPRSS fusion positivity)

| Official Symbol | p-value | Odds Ratio |
|---|---|---|
| ABCC4 | 0.045 | 0.77 |
| ABHD2 | <.001 | 0.38 |
| ACTR2 | 0.027 | 0.73 |
| ADAMTS1 | 0.024 | 0.58 |
| ADH5 | <.001 | 0.58 |
| AGTR2 | 0.016 | 0.64 |
| AKAP1 | 0.013 | 0.70 |
| AKT2 | 0.015 | 0.71 |
| ALCAM | <.001 | 0.45 |
| ALDH1A2 | 0.004 | 0.70 |
| ANPEP | <.001 | 0.43 |
| ANXA2 | 0.010 | 0.71 |
| APC | 0.036 | 0.73 |
| APOC1 | 0.002 | 0.56 |
| APOE | <.001 | 0.44 |
| ARF1 | 0.041 | 0.77 |
| ATM | 0.036 | 0.74 |
| AURKB | <.001 | 0.62 |
| AZGP1 | <.001 | 0.54 |
| BBC3 | 0.030 | 0.74 |
| BCL2 | 0.012 | 0.70 |
| BIN1 | 0.021 | 0.74 |
| BTG1 | 0.004 | 0.67 |
| BTG3 | 0.003 | 0.63 |
| C7 | 0.023 | 0.74 |
| CADM1 | 0.007 | 0.69 |
| CASP1 | 0.011 | 0.70 |
| CAV1 | 0.011 | 0.71 |
| CCND1 | 0.019 | 0.72 |
| CCR1 | 0.022 | 0.73 |
| CD44 | <.001 | 0.57 |
| CD68 | <.001 | 0.54 |
| CD82 | 0.002 | 0.66 |
| CDH5 | 0.007 | 0.66 |
| CDKN1A | <.001 | 0.60 |
| CDKN2B | <.001 | 0.54 |
| CDKN2C | 0.012 | 0.72 |
| CDKN3 | 0.037 | 0.77 |
| CHN1 | 0.038 | 0.75 |
| CKS2 | <.001 | 0.48 |

TABLE 9B-continued

Genes significantly (p < 0.05) associated with TMPRSS fusion status in the primary Gleason pattern with odds ratio (OR) < 1.0 (increased expression is negatively associated with TMPRSS fusion positivity)

| Official Symbol | p-value | Odds Ratio |
|---|---|---|
| COL11A1 | 0.017 | 0.72 |
| COL1A1 | <.001 | 0.59 |
| COL1A2 | 0.001 | 0.62 |
| COL3A1 | 0.027 | 0.73 |
| COL4A1 | 0.043 | 0.76 |
| COL5A1 | 0.039 | 0.74 |
| COL5A2 | 0.026 | 0.73 |
| COL6A1 | 0.008 | 0.66 |
| COL6A3 | <.001 | 0.59 |
| COL8A1 | 0.022 | 0.74 |
| CSF1 | 0.011 | 0.70 |
| CTNNB1 | 0.021 | 0.69 |
| CTSB | <.001 | 0.62 |
| CTSD | 0.036 | 0.68 |
| CTSK | 0.007 | 0.70 |
| CTSS | 0.002 | 0.64 |
| CXCL12 | <.001 | 0.48 |
| CXCR4 | 0.005 | 0.68 |
| CXCR7 | 0.046 | 0.76 |
| CYR61 | 0.004 | 0.65 |
| DAP | 0.002 | 0.64 |
| DARC | 0.021 | 0.73 |
| DDR2 | 0.021 | 0.73 |
| DHRS9 | <.001 | 0.52 |
| DIAPH1 | <.001 | 0.56 |
| DICER1 | 0.029 | 0.75 |
| DLC1 | 0.013 | 0.72 |
| DLGAP1 | <.001 | 0.60 |
| DLL4 | <.001 | 0.57 |
| DPT | 0.006 | 0.68 |
| DUSP1 | 0.012 | 0.68 |
| DUSP6 | 0.001 | 0.62 |
| DVL1 | 0.037 | 0.75 |
| EFNB2 | <.001 | 0.32 |
| EGR1 | 0.003 | 0.65 |
| ELK4 | <.001 | 0.60 |
| ERBB2 | <.001 | 0.61 |
| ERBB3 | 0.045 | 0.76 |
| ESR2 | 0.010 | 0.70 |
| ETV1 | 0.042 | 0.74 |
| FABP5 | <.001 | 0.21 |
| FAM13C | 0.006 | 0.67 |
| FCGR3A | 0.018 | 0.72 |
| FGF17 | 0.009 | 0.71 |
| FGF6 | 0.011 | 0.70 |
| FGF7 | 0.003 | 0.63 |
| FN1 | 0.006 | 0.69 |
| FOS | 0.035 | 0.74 |
| FOXP3 | 0.010 | 0.71 |
| GABRG2 | 0.029 | 0.74 |
| GADD45B | 0.003 | 0.63 |
| GDF15 | <.001 | 0.54 |
| GPM6B | 0.004 | 0.67 |
| GPNMB | 0.001 | 0.62 |
| GSN | 0.009 | 0.69 |
| HLA-G | 0.050 | 0.74 |
| HLF | 0.018 | 0.74 |
| HPS1 | <.001 | 0.48 |
| HSD17B3 | 0.003 | 0.60 |
| HSD17B4 | <.001 | 0.56 |
| HSPB1 | <.001 | 0.38 |
| HSPB2 | 0.002 | 0.62 |
| IFI30 | 0.049 | 0.75 |
| IFNG | 0.006 | 0.64 |
| IGF1 | 0.016 | 0.73 |
| IGF2 | 0.001 | 0.57 |
| IGFBP2 | <.001 | 0.51 |
| IGFBP3 | <.001 | 0.59 |
| IGFBP6 | <.001 | 0.57 |
| IL10 | <.001 | 0.62 |
| IL17A | 0.012 | 0.63 |
| IL1A | 0.011 | 0.59 |
| IL2 | 0.001 | 0.63 |
| IL6ST | <.001 | 0.52 |
| INSL4 | 0.014 | 0.71 |
| ITGA1 | 0.009 | 0.69 |
| ITGA4 | 0.007 | 0.68 |
| JUN | <.001 | 0.59 |
| KIT | <.001 | 0.64 |
| KRT76 | 0.016 | 0.70 |
| LAG3 | 0.002 | 0.63 |
| LAPTM5 | <.001 | 0.58 |
| LGALS3 | <.001 | 0.53 |
| LTBP2 | 0.011 | 0.71 |
| LUM | 0.012 | 0.70 |
| MAOA | 0.020 | 0.73 |
| MAP4K4 | 0.007 | 0.68 |
| MGST1 | <.001 | 0.54 |
| MMP2 | <.001 | 0.61 |
| MPPED2 | <.001 | 0.45 |
| MRC1 | 0.005 | 0.67 |
| MTPN | 0.002 | 0.56 |
| MTSS1 | <.001 | 0.53 |
| MVP | 0.009 | 0.72 |
| MYBPC1 | <.001 | 0.51 |
| MYLK3 | 0.001 | 0.58 |
| NCAM1 | <.001 | 0.59 |
| NCAPD3 | <.001 | 0.40 |
| NCOR1 | 0.004 | 0.69 |
| NFKBIA | <.001 | 0.63 |
| NNMT | 0.006 | 0.66 |
| NPBWR1 | 0.027 | 0.67 |
| OAZ1 | 0.049 | 0.64 |
| OLFML3 | <.001 | 0.56 |
| OSM | <.001 | 0.64 |
| PAGE1 | 0.012 | 0.52 |
| PDGFRB | 0.016 | 0.73 |
| PECAM1 | <.001 | 0.55 |
| PGR | 0.048 | 0.77 |
| PIK3CA | <.001 | 0.55 |
| PIK3CG | 0.008 | 0.71 |
| PLAU | 0.044 | 0.76 |
| PLK1 | 0.006 | 0.68 |
| PLOD2 | 0.013 | 0.71 |
| PLP2 | 0.024 | 0.73 |
| PNLIPRP2 | 0.009 | 0.70 |
| PPAP2B | <.001 | 0.62 |
| PRKAR2B | <.001 | 0.61 |
| PRKCB | 0.044 | 0.76 |
| PROS1 | 0.005 | 0.67 |
| PTEN | <.001 | 0.47 |
| PTGER3 | 0.007 | 0.69 |
| PTH1R | 0.011 | 0.70 |
| PTK2B | <.001 | 0.61 |
| PTPN1 | 0.028 | 0.73 |
| RAB27A | <.001 | 0.21 |
| RAD51 | <.001 | 0.51 |
| RAD9A | 0.030 | 0.75 |
| RARB | <.001 | 0.62 |
| RASSF1 | 0.038 | 0.76 |
| RECK | 0.009 | 0.62 |
| RHOB | 0.004 | 0.64 |
| RHOC | <.001 | 0.56 |
| RLN1 | <.001 | 0.30 |
| RND3 | 0.014 | 0.72 |
| S100P | 0.002 | 0.66 |
| SDC2 | <.001 | 0.61 |
| SEMA3A | 0.001 | 0.64 |
| SMAD4 | <.001 | 0.64 |
| SPARC | <.001 | 0.59 |
| SPARCL1 | <.001 | 0.56 |
| SPINK1 | <.001 | 0.26 |
| SRD5A1 | 0.039 | 0.76 |
| STAT1 | 0.026 | 0.74 |
| STS | 0.006 | 0.64 |
| SULF1 | <.001 | 0.53 |
| TFF3 | <.001 | 0.19 |
| TGFA | 0.002 | 0.65 |

TABLE 9B-continued

Genes significantly (p < 0.05) associated with TMPRSS fusion status in the primary Gleason pattern with odds ratio (OR) < 1.0 (increased expression is negatively associated with TMPRSS fusion positivity)

| Official Symbol | p-value | Odds Ratio |
|---|---|---|
| TGFB1I1 | 0.040 | 0.77 |
| TGFB2 | 0.003 | 0.66 |
| TGFB3 | <.001 | 0.54 |
| TGFBR2 | <.001 | 0.61 |
| THY1 | <.001 | 0.63 |
| TIMP2 | 0.004 | 0.66 |
| TIMP3 | <.001 | 0.60 |
| TMPRSS2 | <.001 | 0.40 |
| TNFSF11 | 0.026 | 0.63 |
| TPD52 | 0.002 | 0.64 |
| TRAM1 | <.001 | 0.45 |
| TRPC6 | 0.002 | 0.64 |
| TUBB2A | <.001 | 0.49 |
| VCL | <.001 | 0.57 |
| VEGFB | 0.033 | 0.73 |
| VEGFC | <.001 | 0.61 |
| VIM | 0.012 | 0.69 |
| WISP1 | 0.030 | 0.75 |
| WNT5A | <.001 | 0.50 |

A molecular field effect was investigated, and determined that the expression levels of histologically normal-appearing cells adjacent to the tumor exhibited a molecular signature of prostate cancer. Tables 10A and 10B provide genes significantly associated (p<0.05), positively or negatively, with cRFI or bRFI in non-tumor samples. Table 10A is negatively associated with good prognosis, while increased expression of genes in Table 10B is positively associated with good prognosis.

TABLE 10A

Genes significantly (p < 0.05) associated with cRFI or bRFI in Non-Tumor Samples with hazard ratio (HR) > 1.0 (increased expression is negatively associated with good prognosis)

| | cRFI | | bRFI | |
|---|---|---|---|---|
| Official Symbol | HR | p-value | HR | p-value |
| ALCAM | | | 1.278 | 0.036 |
| ASPN | 1.309 | 0.032 | | |
| BAG5 | 1.458 | 0.004 | | |
| BRCA2 | 1.385 | <.001 | | |
| CACNA1D | | | 1.329 | 0.035 |
| CD164 | | | 1.339 | 0.020 |
| CDKN2B | 1.398 | 0.014 | | |
| COL3A1 | 1.300 | 0.035 | | |
| COL4A1 | 1.358 | 0.019 | | |
| CTNND2 | | | 1.370 | 0.001 |
| DARC | 1.451 | 0.003 | | |
| DICER1 | | | 1.345 | <.001 |
| DPP4 | | | 1.358 | 0.008 |
| EFNB2 | | | 1.323 | 0.007 |
| FASN | | | 1.327 | 0.035 |
| GHR | | | 1.332 | 0.048 |
| HSPA5 | | | 1.260 | 0.048 |
| INHBA | 1.558 | <.001 | | |
| KCNN2 | | | 1.264 | 0.045 |
| KRT76 | | | 1.115 | <.001 |
| LAMC1 | 1.390 | 0.014 | | |
| LAMC2 | | | 1.216 | 0.042 |
| LIG3 | | | 1.313 | 0.030 |
| MAOA | | | 1.405 | 0.013 |
| MCM6 | 1.307 | 0.036 | | |
| MKI67 | 1.271 | 0.008 | | |
| NEK2 | | | 1.312 | 0.016 |
| NPBWR1 | 1.278 | 0.035 | | |
| ODC1 | | | 1.320 | 0.010 |
| PEX10 | | | 1.361 | 0.014 |
| PGK1 | 1.488 | 0.004 | | |

TABLE 10A-continued

Genes significantly (p < 0.05) associated with cRFI or bRFI in Non-Tumor Samples with hazard ratio (HR) > 1.0 (increased expression is negatively associated with good prognosis)

| | cRFI | | bRFI | |
|---|---|---|---|---|
| Official Symbol | HR | p-value | HR | p-value |
| PLA2G7 | | | 1.337 | 0.025 |
| POSTN | 1.306 | 0.043 | | |
| PTK6 | | | 1.344 | 0.005 |
| REG4 | | | 1.348 | 0.009 |
| RGS7 | | | 1.144 | 0.047 |
| SFRP4 | 1.394 | 0.009 | | |
| TARP | | | 1.412 | 0.011 |
| TFF1 | | | 1.346 | 0.010 |
| TGFBR2 | 1.310 | 0.035 | | |
| THY1 | 1.300 | 0.038 | | |
| TMPRSS2ERGA | | | 1.333 | <.001 |
| TPD52 | | | 1.374 | 0.015 |
| TRPC6 | 1.272 | 0.046 | | |
| UBE2C | 1.323 | 0.007 | | |
| UHRF1 | 1.325 | 0.021 | | |

TABLE 10B

Genes significantly (p < 0.05) associated with cRFI or bRFI in Non-Tumor Samples with hazard ratio (HR) < 1.0 (increased expression is positively associated with good prognosis)

| | cRFI | | bRFI | |
|---|---|---|---|---|
| Official Symbol | HR | p-value | HR | p-value |
| ABCA5 | 0.807 | 0.028 | | |
| ABCC3 | 0.760 | 0.019 | 0.750 | 0.003 |
| ABHD2 | 0.781 | 0.028 | | |
| ADAM15 | 0.718 | 0.005 | | |
| AKAP1 | 0.740 | 0.009 | | |
| AMPD3 | | | 0.793 | 0.013 |
| ANGPT2 | | | 0.752 | 0.027 |
| ANXA2 | | | 0.776 | 0.035 |
| APC | 0.755 | 0.014 | | |
| APRT | 0.762 | 0.025 | | |
| AR | 0.752 | 0.015 | | |
| ARHGDIB | | | 0.753 | <.001 |
| BIN1 | 0.738 | 0.016 | | |
| CADM1 | 0.711 | 0.004 | | |
| CCNH | 0.820 | 0.041 | | |
| CCR1 | | | 0.749 | 0.007 |
| CDK14 | | | 0.772 | 0.014 |
| CDK3 | 0.819 | 0.044 | | |
| CDKN1C | 0.808 | 0.038 | | |
| CHAF1A | 0.634 | 0.002 | 0.779 | 0.045 |
| CHN1 | | | 0.803 | 0.034 |
| CHRAC1 | 0.751 | 0.014 | 0.779 | 0.021 |
| COL5A1 | | | 0.736 | 0.012 |
| COL5A2 | | | 0.762 | 0.013 |
| COL6A1 | | | 0.757 | 0.032 |
| COL6A3 | | | 0.757 | 0.019 |
| CSK | 0.663 | <.001 | 0.698 | <.001 |
| CTSK | | | 0.782 | 0.029 |
| CXCL12 | | | 0.771 | 0.037 |
| CXCR7 | | | 0.753 | 0.008 |
| CYP3A5 | 0.790 | 0.035 | | |
| DDIT4 | | | 0.725 | 0.017 |
| DIAPH1 | | | 0.771 | 0.015 |
| DLC1 | 0.744 | 0.004 | 0.807 | 0.015 |
| DLGAP1 | 0.708 | 0.004 | | |
| DUSP1 | 0.740 | 0.034 | | |
| EDN1 | | | 0.742 | 0.010 |
| EGR1 | 0.731 | 0.028 | | |
| EIF3H | 0.761 | 0.024 | | |
| EIF4E | 0.786 | 0.041 | | |
| ERBB2 | 0.664 | 0.001 | | |
| ERBB4 | 0.764 | 0.036 | | |
| ERCC1 | 0.804 | 0.041 | | |

TABLE 10B-continued

Genes significantly (p < 0.05) associated with cRFI or bRFI in Non-Tumor Samples with hazard ratio (HR) < 1.0 (increased expression is positively associated with good prognosis)

| Official Symbol | cRFI HR | cRFI p-value | bRFI HR | bRFI p-value |
|---|---|---|---|---|
| ESR2 | | | 0.757 | 0.025 |
| EZH2 | | | 0.798 | 0.048 |
| FAAH | 0.798 | 0.042 | | |
| FAM13C | 0.764 | 0.012 | | |
| FAM171B | | | 0.755 | 0.005 |
| FAM49B | | | 0.811 | 0.043 |
| FAM73A | 0.778 | 0.015 | | |
| FASLG | | | 0.757 | 0.041 |
| FGFR2 | 0.735 | 0.016 | | |
| FOS | 0.690 | 0.008 | | |
| FYN | 0.788 | 0.035 | 0.777 | 0.011 |
| GPNMB | | | 0.762 | 0.011 |
| GSK3B | 0.792 | 0.038 | | |
| HGD | 0.774 | 0.017 | | |
| HIRIP3 | 0.802 | 0.033 | | |
| HSP90AB1 | 0.753 | 0.013 | | |
| HSPB1 | 0.764 | 0.021 | | |
| HSPE1 | 0.668 | 0.001 | | |
| IFI30 | | | 0.732 | 0.002 |
| IGF2 | | | 0.747 | 0.006 |
| IGFBP5 | | | 0.691 | 0.006 |
| IL6ST | | | 0.748 | 0.010 |
| IL8 | | | 0.785 | 0.028 |
| IMMT | | | 0.708 | <.001 |
| ITGA6 | 0.747 | 0.008 | | |
| ITGAV | | | 0.792 | 0.016 |
| ITGB3 | | | 0.814 | 0.034 |
| ITPR3 | 0.769 | 0.009 | | |
| JUN | 0.655 | 0.005 | | |
| KHDRBS3 | | | 0.764 | 0.012 |
| KLF6 | 0.714 | <.001 | | |
| KLK2 | 0.813 | 0.048 | | |
| LAMA4 | | | 0.702 | 0.009 |
| LAMA5 | 0.744 | 0.011 | | |
| LAPTM5 | | | 0.740 | 0.009 |
| LGALS3 | 0.773 | 0.036 | 0.788 | 0.024 |
| LIMS1 | | | 0.807 | 0.012 |
| MAP3K5 | | | 0.815 | 0.034 |
| MAP3K7 | | | 0.809 | 0.032 |
| MAP4K4 | 0.735 | 0.018 | 0.761 | 0.010 |
| MAPKAPK3 | 0.754 | 0.014 | | |
| MICA | 0.785 | 0.019 | | |
| MTA1 | | | 0.808 | 0.043 |
| MVP | | | 0.691 | 0.001 |
| MYLK3 | | | 0.730 | 0.039 |
| MYO6 | 0.780 | 0.037 | | |
| NCOA1 | | | 0.787 | 0.040 |
| NCOR1 | | | 0.876 | 0.020 |
| NDRG1 | 0.761 | <.001 | | |
| NFAT5 | 0.770 | 0.032 | | |
| NFKBIA | | | 0.799 | 0.018 |
| NME2 | | | 0.753 | 0.005 |
| NUP62 | | | 0.842 | 0.032 |
| OAZ1 | | | 0.803 | 0.043 |
| OLFML2B | | | 0.745 | 0.023 |
| OLFML3 | | | 0.743 | 0.009 |
| OSM | | | 0.726 | 0.018 |
| PCA3 | 0.714 | 0.019 | | |
| PECAM1 | | | 0.774 | 0.023 |
| PIK3C2A | | | 0.768 | 0.001 |
| PIM1 | 0.725 | 0.011 | | |
| PLOD2 | | | 0.713 | 0.008 |
| PPP3CA | 0.768 | 0.040 | | |
| PROM1 | | | 0.482 | <.001 |
| PTEN | | | 0.807 | 0.012 |
| PTGS2 | 0.726 | 0.011 | | |
| PTTG1 | | | 0.729 | 0.006 |
| PYCARD | | | 0.783 | 0.012 |
| RAB30 | | | 0.730 | 0.002 |
| RAGE | 0.792 | 0.012 | | |
| RFX1 | 0.789 | 0.016 | 0.792 | 0.010 |
| RGS10 | 0.781 | 0.017 | | |
| RUNX1 | | | 0.747 | 0.007 |
| SDHC | | | 0.827 | 0.036 |
| SEC23A | | | 0.752 | 0.010 |
| SEPT9 | | | 0.889 | 0.006 |
| SERPINA3 | | | 0.738 | 0.013 |
| SLC25A21 | | | 0.788 | 0.045 |
| SMARCD1 | 0.788 | 0.010 | 0.733 | 0.007 |
| SMO | 0.813 | 0.035 | | |
| SRC | 0.758 | 0.026 | | |
| SRD5A2 | | | 0.738 | 0.005 |
| ST5 | | | 0.767 | 0.022 |
| STAT5A | | | 0.784 | 0.039 |
| TGFB2 | 0.771 | 0.027 | | |
| TGFB3 | | | 0.752 | 0.036 |
| THBS2 | | | 0.751 | 0.015 |
| TNFRSF10B | 0.739 | 0.010 | | |
| TPX2 | | | 0.754 | 0.023 |
| TRAF3IP2 | | | 0.774 | 0.015 |
| TRAM1 | 0.868 | <.001 | 0.880 | <.001 |
| TRIM14 | 0.785 | 0.047 | | |
| TUBB2A | 0.705 | 0.010 | | |
| TYMP | | | 0.778 | 0.024 |
| UAP1 | 0.721 | 0.013 | | |
| UTP23 | 0.763 | 0.007 | 0.826 | 0.018 |
| VCL | | | 0.837 | 0.040 |
| VEGFA | 0.755 | 0.009 | | |
| WDR19 | 0.724 | 0.005 | | |
| YBX1 | | | 0.786 | 0.027 |
| ZFP36 | | | 0.744 | 0.032 |
| ZNF827 | 0.770 | 0.043 | | |

Table 11 provides genes that are significantly associated (p<0.05) with cRFI or bRFI after adjustment for Gleason pattern or highest Gleason pattern.

TABLE 11

Genes significantly (p < 0.05) associated with cRFI or bRFI after adjustment for Gleason pattern in the primary Gleason pattern or highest Gleason pattern Some HR <=1.0 and some HR >1.0

| Table 11 Official Symbol | cRFI Highest Pattern HR | p-value | bRFI Primary Pattern HR | p-value | bRFI Highest Pattern HR | p-value |
|---|---|---|---|---|---|---|
| HSPA5 | 0.710 | 0.009 | 1.288 | 0.030 | | |
| ODC1 | 0.741 | 0.026 | 1.343 | 0.004 | 1.261 | 0.046 |

Tables 12A and 12B provide genes that are significantly associated (p<0.05) with prostate cancer specific survival (PCSS) in the primary Gleason pattern. Increased expression of genes in Table 12A is negatively associated with good prognosis, while increased expression of genes in Table 12B is positively associated with good prognosis.

TABLE 12A

Genes significantly (p < 0.05) associated with prostate cancer specific survival (PCSS) in the Primary Gleason Pattern HR > 1.0 (Increased expression is negatively associated with good prognosis)

| Official Symbol | HR | p-value |
|---|---|---|
| AKR1C3 | 1.476 | 0.016 |
| ANLN | 1.517 | 0.006 |

TABLE 12A-continued

Genes significantly (p < 0.05) associated with prostate cancer specific survival (PCSS) in the Primary Gleason Pattern HR > 1.0 (Increased expression is negatively associated with good prognosis)

| Official Symbol | HR | p-value |
|---|---|---|
| APOC1 | 1.285 | 0.016 |
| APOE | 1.490 | 0.024 |
| ASPN | 3.055 | <.001 |
| ATP5E | 1.788 | 0.012 |
| AURKB | 1.439 | 0.008 |
| BGN | 2.640 | <.001 |
| BIRC5 | 1.611 | <.001 |
| BMP6 | 1.490 | 0.021 |
| BRCA1 | 1.418 | 0.036 |
| CCNB1 | 1.497 | 0.021 |
| CD276 | 1.668 | 0.005 |
| CDC20 | 1.730 | <.001 |
| CDH11 | 1.565 | 0.017 |
| CDH7 | 1.553 | 0.007 |
| CDKN2B | 1.751 | 0.003 |
| CDKN2C | 1.993 | 0.013 |
| CDKN3 | 1.404 | 0.008 |
| CENPF | 2.031 | <.001 |
| CHAF1A | 1.376 | 0.011 |
| CKS2 | 1.499 | 0.031 |
| COL1A1 | 2.574 | <.001 |
| COL1A2 | 1.607 | 0.011 |
| COL3A1 | 2.382 | <.001 |
| COL4A1 | 1.970 | <.001 |
| COL5A2 | 1.938 | 0.002 |
| COL8A1 | 2.245 | <.001 |
| CTHRC1 | 2.085 | <.001 |
| CXCR4 | 1.783 | 0.007 |
| DDIT4 | 1.535 | 0.030 |
| DYNLL1 | 1.719 | 0.001 |
| F2R | 2.169 | <.001 |
| FAM171B | 1.430 | 0.044 |
| FAP | 1.993 | 0.002 |
| FCGR3A | 2.099 | <.001 |
| FN1 | 1.537 | 0.024 |
| GPR68 | 1.520 | 0.018 |
| GREM1 | 1.942 | <.001 |
| IFI30 | 1.482 | 0.048 |
| IGFBP3 | 1.513 | 0.027 |
| INHBA | 3.060 | <.001 |
| KIF4A | 1.355 | 0.001 |
| KLK14 | 1.187 | 0.004 |
| LAPTM5 | 1.613 | 0.006 |
| LTBP2 | 2.018 | <.001 |
| MMP11 | 1.869 | <.001 |
| MYBL2 | 1.737 | 0.013 |
| NEK2 | 1.445 | 0.028 |
| NOX4 | 2.049 | <.001 |
| OLFML2B | 1.497 | 0.023 |
| PLK1 | 1.603 | 0.006 |
| POSTN | 2.585 | <.001 |
| PPFIA3 | 1.502 | 0.012 |
| PTK6 | 1.527 | 0.009 |
| PTTG1 | 1.382 | 0.029 |
| RAD51 | 1.304 | 0.031 |
| RGS7 | 1.251 | <.001 |
| RRM2 | 1.515 | <.001 |
| SAT1 | 1.607 | 0.004 |
| SDC1 | 1.710 | 0.007 |
| SESN3 | 1.399 | 0.045 |
| SFRP4 | 2.384 | <.001 |
| SHMT2 | 1.949 | 0.003 |
| SPARC | 2.249 | <.001 |
| STMN1 | 1.748 | 0.021 |
| SULF1 | 1.803 | 0.004 |
| THBS2 | 2.576 | <.001 |
| THY1 | 1.908 | 0.001 |
| TK1 | 1.394 | 0.004 |
| TOP2A | 2.119 | <.001 |
| TPX2 | 2.074 | 0.042 |
| UBE2C | 1.598 | <.001 |
| UGT2B15 | 1.363 | 0.016 |
| UHRF1 | 1.642 | 0.001 |
| ZWINT | 1.570 | 0.010 |

TABLE 12B

Genes significantly (p < 0.05) associated with prostate cancer specific survival (PCSS) in the Primary Gleason Pattern HR < 1.0 (Increased expression is positively associated with good prognosis)

| Official Symbol | HR | p-value |
|---|---|---|
| AAMP | 0.649 | 0.040 |
| ABCA5 | 0.777 | 0.015 |
| ABCG2 | 0.715 | 0.037 |
| ACOX2 | 0.673 | 0.016 |
| ADH5 | 0.522 | <.001 |
| ALDH1A2 | 0.561 | <.001 |
| AMACR | 0.693 | 0.029 |
| AMPD3 | 0.750 | 0.049 |
| ANPEP | 0.531 | <.001 |
| ATXN1 | 0.640 | 0.011 |
| AXIN2 | 0.657 | 0.002 |
| AZGP1 | 0.617 | <.001 |
| BDKRB1 | 0.553 | 0.032 |
| BIN1 | 0.658 | <.001 |
| BTRC | 0.716 | 0.011 |
| C7 | 0.531 | <.001 |
| CADM1 | 0.646 | 0.015 |
| CASP7 | 0.538 | 0.029 |
| CCNH | 0.674 | 0.001 |
| CD164 | 0.606 | <.001 |
| CD44 | 0.687 | 0.016 |
| CDK3 | 0.733 | 0.039 |
| CHN1 | 0.653 | 0.014 |
| COL6A1 | 0.681 | 0.015 |
| CSF1 | 0.675 | 0.019 |
| CSRP1 | 0.711 | 0.007 |
| CXCL12 | 0.650 | 0.015 |
| CYP3A5 | 0.507 | <.001 |
| CYR61 | 0.569 | 0.007 |
| DLGAP1 | 0.654 | 0.004 |
| DNM3 | 0.692 | 0.010 |
| DPP4 | 0.544 | <.001 |
| DPT | 0.543 | <.001 |
| DUSP1 | 0.660 | 0.050 |
| DUSP6 | 0.699 | 0.033 |
| EGR1 | 0.490 | <.001 |
| EGR3 | 0.561 | <.001 |
| EIF5 | 0.720 | 0.035 |
| ERBB3 | 0.739 | 0.042 |
| FAAH | 0.636 | 0.010 |
| FAM107A | 0.541 | <.001 |
| FAM13C | 0.526 | <.001 |
| FAS | 0.689 | 0.030 |
| FGF10 | 0.657 | 0.024 |
| FKBP5 | 0.699 | 0.040 |
| FLNC | 0.742 | 0.036 |
| FOS | 0.556 | 0.005 |
| FOXQ1 | 0.666 | 0.007 |
| GADD45B | 0.554 | 0.002 |
| GDF15 | 0.659 | 0.009 |
| GHR | 0.683 | 0.027 |
| GPM6B | 0.666 | 0.005 |
| GSN | 0.646 | 0.006 |
| GSTM1 | 0.672 | 0.006 |
| GSTM2 | 0.514 | <.001 |
| HGD | 0.771 | 0.039 |
| HIRIP3 | 0.730 | 0.013 |
| HK1 | 0.778 | 0.048 |
| HLF | 0.581 | <.001 |
| HNF1B | 0.643 | 0.013 |

TABLE 12B-continued

Genes significantly (p < 0.05) associated with prostate cancer specific survival (PCSS) in the Primary Gleason Pattern HR < 1.0 (Increased expression is positively associated with good prognosis)

| Official Symbol | HR | p-value |
|---|---|---|
| HSD17B10 | 0.742 | 0.029 |
| IER3 | 0.717 | 0.049 |
| IGF1 | 0.612 | <.001 |
| IGFBP6 | 0.578 | 0.003 |
| IL2 | 0.528 | 0.010 |
| IL6ST | 0.574 | <.001 |
| IL8 | 0.540 | 0.001 |
| ING5 | 0.688 | 0.015 |
| ITGA6 | 0.710 | 0.005 |
| ITGA7 | 0.676 | 0.033 |
| JUN | 0.506 | 0.001 |
| KIT | 0.628 | 0.047 |
| KLK1 | 0.523 | 0.002 |
| KLK2 | 0.581 | <.001 |
| KLK3 | 0.676 | <.001 |
| KRT15 | 0.684 | 0.005 |
| KRT18 | 0.536 | <.001 |
| KRT5 | 0.673 | 0.004 |
| KRT8 | 0.613 | 0.006 |
| LAMB3 | 0.740 | 0.027 |
| LGALS3 | 0.678 | 0.007 |
| MGST1 | 0.640 | 0.002 |
| MPPED2 | 0.629 | <.001 |
| MTSS1 | 0.705 | 0.041 |
| MYBPC1 | 0.534 | <.001 |
| NCAPD3 | 0.519 | <.001 |
| NFAT5 | 0.536 | <.001 |
| NRG1 | 0.467 | 0.007 |
| OLFML3 | 0.646 | 0.001 |
| OMD | 0.630 | 0.006 |
| OR51E2 | 0.762 | 0.017 |
| PAGE4 | 0.518 | <.001 |
| PCA3 | 0.581 | <.001 |
| PGF | 0.705 | 0.038 |
| PPAP2B | 0.568 | <.001 |
| PPP1R12A | 0.694 | 0.017 |
| PRIMA1 | 0.678 | 0.014 |
| PRKCA | 0.632 | 0.001 |
| PRKCB | 0.692 | 0.028 |
| PROM1 | 0.393 | 0.017 |
| PTEN | 0.689 | 0.002 |
| PTGS2 | 0.611 | 0.004 |
| PTH1R | 0.629 | 0.031 |
| RAB27A | 0.721 | 0.046 |
| RND3 | 0.678 | 0.029 |
| RNF114 | 0.714 | 0.035 |
| SDHC | 0.590 | <.001 |
| SERPINA3 | 0.710 | 0.050 |
| SH3RF2 | 0.570 | 0.005 |
| SLC22A3 | 0.517 | <.001 |
| SMAD4 | 0.528 | <.001 |
| SMO | 0.751 | 0.026 |
| SRC | 0.667 | 0.004 |
| SRD5A2 | 0.488 | <.001 |
| STAT5B | 0.700 | 0.040 |
| SVIL | 0.694 | 0.024 |
| TFF3 | 0.701 | 0.045 |
| TGFB1I1 | 0.670 | 0.029 |
| TGFB2 | 0.646 | 0.010 |
| TNFRSF10B | 0.685 | 0.014 |
| TNFSF10 | 0.532 | <.001 |
| TPM2 | 0.623 | 0.005 |
| TRO | 0.767 | 0.049 |
| TUBB2A | 0.613 | 0.003 |
| VEGFB | 0.780 | 0.034 |
| ZFP36 | 0.576 | 0.001 |
| ZNF827 | 0.644 | 0.014 |

Analysis of gene expression and upgrading/upstaging was based on univariate ordinal logistic regression models using weighted maximum likelihood estimators for each gene in the gene list (727 test genes and 5 reference genes). P-values were generated using a Wald test of the null hypothesis that the odds ratio (OR) is one. Both unadjusted p-values and the q-value (smallest FDR at which the hypothesis test in question is rejected) were reported. Un-adjusted p-values <0.05 were considered statistically significant. Since two tumor specimens were selected for each patient, this analysis was performed using the 2 specimens from each patient as follows: (1) analysis using the primary Gleason pattern specimen from each patient (Specimens A1 and B2 as described in Table 2); and (2) analysis using the highest Gleason pattern specimen from each patient (Specimens A1 and B1 as described in Table 2). 200 genes were found to be significantly associated (p<0.05) with upgrading/upstaging in the primary Gleason pattern sample (PGP) and 203 genes were found to be significantly associated (p<0.05) with upgrading/upstaging in the highest Gleason pattern sample (HGP).

Tables 13A and 13B provide genes significantly associated (p<0.05), positively or negatively, with upgrading/upstaging in the primary and/or highest Gleason pattern. Increased expression of genes in Table 13A is positively associated with higher risk of upgrading/upstaging (poor prognosis), while increased expression of genes in Table 13B is negatively associated with risk of upgrading/upstaging (good prognosis).

TABLE 13A

Genes significantly (p < 0.05) associated with upgrading/upstaging in the Primary Gleason Pattern (PGP) and Highest Gleason Pattern (HGP) OR > 1.0 (Increased expression is positively associated with higher risk of upgrading/upstaging (poor prognosis))

| Gene | PGP OR | PGP p-value | HGP OR | HGP p-value |
|---|---|---|---|---|
| ALCAM | 1.52 | 0.0179 | 1.50 | 0.0184 |
| ANLN | 1.36 | 0.0451 | . | . |
| APOE | 1.42 | 0.0278 | 1.50 | 0.0140 |
| ASPN | 1.60 | 0.0027 | 2.06 | 0.0001 |
| AURKA | 1.47 | 0.0108 | . | . |
| AURKB | . | . | 1.52 | 0.0070 |
| BAX | . | . | 1.48 | 0.0095 |
| BGN | 1.58 | 0.0095 | 1.73 | 0.0034 |
| BIRC5 | 1.38 | 0.0415 | . | . |
| BMP6 | 1.51 | 0.0091 | 1.59 | 0.0071 |
| BUB1 | 1.38 | 0.0471 | 1.59 | 0.0068 |
| CACNA1D | 1.36 | 0.0474 | 1.52 | 0.0078 |
| CASP7 | . | . | 1.32 | 0.0450 |
| CCNE2 | 1.54 | 0.0042 | . | . |
| CD276 | . | . | 1.44 | 0.0265 |
| CDC20 | 1.35 | 0.0445 | 1.39 | 0.0225 |
| CDKN2B | . | . | 1.36 | 0.0415 |
| CENPF | 1.43 | 0.0172 | 1.48 | 0.0102 |
| CLTC | 1.59 | 0.0031 | 1.57 | 0.0038 |
| COL1A1 | 1.58 | 0.0045 | 1.75 | 0.0008 |
| COL3A1 | 1.45 | 0.0143 | 1.47 | 0.0131 |
| COL8A1 | 1.40 | 0.0292 | 1.43 | 0.0258 |
| CRISP3 | . | . | 1.40 | 0.0256 |
| CTHRC1 | . | . | 1.56 | 0.0092 |
| DBN1 | 1.43 | 0.0323 | 1.45 | 0.0163 |
| DIAPH1 | 1.51 | 0.0088 | 1.58 | 0.0025 |
| DICER1 | . | . | 1.40 | 0.0293 |
| DIO2 | . | . | 1.49 | 0.0097 |
| DVL1 | . | . | 1.53 | 0.0160 |
| F2R | 1.46 | 0.0346 | 1.63 | 0.0024 |
| FAP | 1.47 | 0.0136 | 1.74 | 0.0005 |
| FCGR3A | . | . | 1.42 | 0.0221 |
| HPN | . | . | 1.36 | 0.0468 |
| HSD17B4 | . | . | 1.47 | 0.0151 |
| HSPA8 | 1.65 | 0.0060 | 1.58 | 0.0074 |
| IL11 | 1.50 | 0.0100 | 1.48 | 0.0113 |
| IL1B | 1.41 | 0.0359 | . | . |
| INHBA | 1.56 | 0.0064 | 1.71 | 0.0042 |
| KHDRBS3 | 1.43 | 0.0219 | 1.59 | 0.0045 |
| KIF4A | . | . | 1.50 | 0.0209 |

TABLE 13A-continued

Genes significantly (p < 0.05) associated with upgrading/upstaging in the Primary Gleason Pattern (PGP) and Highest Gleason Pattern (HGP) OR > 1.0 (Increased expression is positively associated with higher risk of upgrading/upstaging (poor prognosis))

| Gene | PGP OR | PGP p-value | HGP OR | HGP p-value |
| --- | --- | --- | --- | --- |
| KPNA2 | 1.40 | 0.0366 | . | . |
| KRT2 | . | . | 1.37 | 0.0456 |
| KRT75 | . | . | 1.44 | 0.0389 |
| MANF | . | . | 1.39 | 0.0429 |
| MELK | 1.74 | 0.0016 | . | . |
| MKI67 | 1.35 | 0.0408 | . | . |
| MMP11 | . | . | 1.56 | 0.0057 |
| NOX4 | 1.49 | 0.0105 | 1.49 | 0.0138 |
| PLAUR | 1.44 | 0.0185 | . | . |
| PLK1 | . | . | 1.41 | 0.0246 |
| PTK6 | . | . | 1.36 | 0.0391 |
| RAD51 | . | . | 1.39 | 0.0300 |
| RAF1 | . | . | 1.58 | 0.0036 |
| RRM2 | 1.57 | 0.0080 | . | . |
| SESN3 | 1.33 | 0.0465 | . | . |
| SFRP4 | 2.33 | <0.0001 | 2.51 | 0.0015 |
| SKIL | 1.44 | 0.0288 | 1.40 | 0.0368 |
| SOX4 | 1.50 | 0.0087 | 1.59 | 0.0022 |
| SPINK1 | 1.52 | 0.0058 | . | . |
| SPP1 | . | . | 1.42 | 0.0224 |
| THBS2 | . | . | 1.36 | 0.0461 |
| TK1 | . | . | 1.38 | 0.0283 |
| TOP2A | 1.85 | 0.0001 | 1.66 | 0.0011 |
| TPD52 | 1.78 | 0.0003 | 1.64 | 0.0041 |
| TPX2 | 1.70 | 0.0010 | . | . |
| UBE2G1 | 1.38 | 0.0491 | . | . |
| UBE2T | 1.37 | 0.0425 | 1.46 | 0.0162 |
| UHRF1 | . | . | 1.43 | 0.0164 |
| VCPIP1 | . | . | 1.37 | 0.0458 |

TABLE 13B

Genes significantly (p < 0.05) associated with upgrading/upstaging in the Primary Gleason Pattern (PGP) and Highest Gleason Pattern (HGP) OR < 1.0 (Increased expression is negatively associated with higher risk of upgrading/upstaging (good prognosis))

| Gene | PGP OR | PGP p-value | HGP OR | HGP p-value |
| --- | --- | --- | --- | --- |
| ABCC3 | . | . | 0.70 | 0.0216 |
| ABCC8 | 0.66 | 0.0121 | . | . |
| ABCG2 | 0.67 | 0.0208 | 0.61 | 0.0071 |
| ACE | . | . | 0.73 | 0.0442 |
| ACOX2 | 0.46 | 0.0000 | 0.49 | 0.0001 |
| ADH5 | 0.69 | 0.0284 | 0.59 | 0.0047 |
| AIG1 | . | . | 0.60 | 0.0045 |
| AKR1C1 | . | . | 0.66 | 0.0095 |
| ALDH1A2 | 0.36 | <0.0001 | 0.36 | <0.0001 |
| ALKBH3 | 0.70 | 0.0281 | 0.61 | 0.0056 |
| ANPEP | . | . | 0.68 | 0.0109 |
| ANXA2 | 0.73 | 0.0411 | 0.66 | 0.0080 |
| APC | . | . | 0.68 | 0.0223 |
| ATXN1 | . | . | 0.70 | 0.0188 |
| AXIN2 | 0.60 | 0.0072 | 0.68 | 0.0204 |
| AZGP1 | 0.66 | 0.0089 | 0.57 | 0.0028 |
| BCL2 | . | . | 0.71 | 0.0182 |
| BIN1 | 0.55 | 0.0005 | . | . |
| BTRC | 0.69 | 0.0397 | 0.70 | 0.0251 |
| C7 | 0.53 | 0.0002 | 0.51 | <0.0001 |
| CADM1 | 0.57 | 0.0012 | 0.60 | 0.0032 |
| CASP1 | 0.64 | 0.0035 | 0.72 | 0.0210 |
| CAV1 | 0.64 | 0.0097 | 0.59 | 0.0032 |
| CAV2 | . | . | 0.58 | 0.0107 |
| CD164 | . | . | 0.69 | 0.0260 |
| CD82 | 0.67 | 0.0157 | 0.69 | 0.0167 |
| CDH1 | 0.61 | 0.0012 | 0.70 | 0.0210 |
| CDK14 | 0.70 | 0.0354 | . | . |
| CDK3 | . | . | 0.72 | 0.0267 |
| CDKN1C | 0.61 | 0.0036 | 0.56 | 0.0003 |
| CHN1 | 0.71 | 0.0214 | . | . |
| COL6A1 | 0.62 | 0.0125 | 0.60 | 0.0050 |
| COL6A3 | 0.65 | 0.0080 | 0.68 | 0.0181 |
| CSRP1 | 0.43 | 0.0001 | 0.40 | 0.0002 |
| CTSB | 0.66 | 0.0042 | 0.67 | 0.0051 |
| CTSD | 0.64 | 0.0355 | . | . |
| CTSK | 0.69 | 0.0171 | . | . |
| CTSL1 | 0.72 | 0.0402 | . | . |
| CUL1 | 0.61 | 0.0024 | 0.70 | 0.0120 |
| CXCL12 | 0.69 | 0.0287 | 0.63 | 0.0053 |
| CYP3A5 | 0.68 | 0.0099 | 0.62 | 0.0026 |
| DDR2 | 0.68 | 0.0324 | 0.62 | 0.0050 |
| DES | 0.54 | 0.0013 | 0.46 | 0.0002 |
| DHX9 | 0.67 | 0.0164 | . | . |
| DLGAP1 | . | . | 0.66 | 0.0086 |
| DPP4 | 0.69 | 0.0438 | 0.69 | 0.0132 |
| DPT | 0.59 | 0.0034 | 0.51 | 0.0005 |
| DUSP1 | . | . | 0.67 | 0.0214 |
| EDN1 | . | . | 0.66 | 0.0073 |
| EDNRA | 0.66 | 0.0148 | 0.54 | 0.0005 |
| EIF2C2 | . | . | 0.65 | 0.0087 |
| ELK4 | 0.55 | 0.0003 | 0.58 | 0.0013 |
| ENPP2 | 0.65 | 0.0128 | 0.59 | 0.0007 |
| EPHA3 | 0.71 | 0.0397 | 0.73 | 0.0455 |
| EPHB2 | 0.60 | 0.0014 | . | . |
| EPHB4 | 0.73 | 0.0418 | . | . |
| EPHX3 | . | . | 0.71 | 0.0419 |
| ERCC1 | 0.71 | 0.0325 | . | . |
| FAM107A | 0.56 | 0.0008 | 0.55 | 0.0011 |
| FAM13C | 0.68 | 0.0276 | 0.55 | 0.0001 |
| FAS | 0.72 | 0.0404 | . | . |
| FBN1 | 0.72 | 0.0395 | . | . |
| FBXW7 | 0.69 | 0.0417 | . | . |
| FGF10 | 0.59 | 0.0024 | 0.51 | 0.0001 |
| FGF7 | 0.51 | 0.0002 | 0.56 | 0.0007 |
| FGFR2 | 0.54 | 0.0004 | 0.47 | <0.0001 |
| FLNA | 0.58 | 0.0036 | 0.50 | 0.0002 |
| FLNC | 0.45 | 0.0001 | 0.40 | <0.0001 |
| FLT4 | 0.61 | 0.0045 | . | . |
| FOXO1 | 0.55 | 0.0005 | 0.53 | 0.0005 |
| FOXP3 | 0.71 | 0.0275 | 0.72 | 0.0354 |
| GHR | 0.59 | 0.0074 | 0.53 | 0.0001 |
| GNRH1 | 0.72 | 0.0386 | . | . |
| GPM6B | 0.59 | 0.0024 | 0.52 | 0.0002 |
| GSN | 0.65 | 0.0107 | 0.65 | 0.0098 |
| GSTM1 | 0.44 | <0.0001 | 0.43 | <0.0001 |
| GSTM2 | 0.42 | <0.0001 | 0.39 | <0.0001 |
| HLF | 0.46 | <0.0001 | 0.47 | 0.0001 |
| HPS1 | 0.64 | 0.0069 | 0.69 | 0.0134 |
| HSPA5 | 0.68 | 0.0113 | . | . |
| HSPB2 | 0.61 | 0.0061 | 0.55 | 0.0004 |
| HSPG2 | 0.70 | 0.0359 | . | . |
| ID3 | . | . | 0.70 | 0.0245 |
| IGF1 | 0.45 | <0.0001 | 0.50 | 0.0005 |
| IGF2 | 0.67 | 0.0200 | 0.68 | 0.0152 |
| IGFBP2 | 0.59 | 0.0017 | 0.69 | 0.0250 |
| IGFBP6 | 0.49 | <0.0001 | 0.64 | 0.0092 |
| IL6ST | 0.56 | 0.0009 | 0.60 | 0.0012 |
| ILK | 0.51 | 0.0010 | 0.49 | 0.0004 |
| ITGA1 | 0.58 | 0.0020 | 0.58 | 0.0016 |
| ITGA3 | 0.71 | 0.0286 | 0.70 | 0.0221 |
| ITGA5 | . | . | 0.69 | 0.0183 |
| ITGA7 | 0.56 | 0.0035 | 0.42 | <0.0001 |
| ITGB1 | 0.63 | 0.0095 | 0.68 | 0.0267 |
| ITGB3 | 0.62 | 0.0043 | 0.62 | 0.0040 |
| ITPR1 | 0.62 | 0.0032 | . | . |
| JUN | 0.73 | 0.0490 | 0.68 | 0.0152 |
| KIT | 0.55 | 0.0003 | 0.57 | 0.0005 |

TABLE 13B-continued

Genes significantly (p < 0.05) associated with upgrading/upstaging in the Primary Gleason Pattern (PGP) and Highest Gleason Pattern (HGP) OR < 1.0 (Increased expression is negatively associated with higher risk of upgrading/upstaging (good prognosis))

| Gene | PGP OR | PGP p-value | HGP OR | HGP p-value |
|---|---|---|---|---|
| KLC1 | . | . | 0.70 | 0.0248 |
| KLK1 | . | . | 0.60 | 0.0059 |
| KRT15 | 0.58 | 0.0009 | 0.45 | <0.0001 |
| KRT5 | 0.70 | 0.0262 | 0.59 | 0.0008 |
| LAMA4 | 0.56 | 0.0359 | 0.68 | 0.0498 |
| LAMB3 | . | . | 0.60 | 0.0017 |
| LGALS3 | 0.58 | 0.0007 | 0.56 | 0.0012 |
| LRP1 | 0.69 | 0.0176 | . | . |
| MAP3K7 | 0.70 | 0.0233 | 0.73 | 0.0392 |
| MCM3 | 0.72 | 0.0320 | . | . |
| MMP2 | 0.66 | 0.0045 | 0.60 | 0.0009 |
| MMP7 | 0.61 | 0.0015 | 0.65 | 0.0032 |
| MMP9 | 0.64 | 0.0057 | 0.72 | 0.0399 |
| MPPED2 | 0.72 | 0.0392 | 0.63 | 0.0042 |
| MTA1 | . | . | 0.68 | 0.0095 |
| MTSS1 | 0.58 | 0.0007 | 0.71 | 0.0442 |
| MVP | 0.57 | 0.0003 | 0.70 | 0.0152 |
| MYBPC1 | . | . | 0.70 | 0.0359 |
| NCAM1 | 0.63 | 0.0104 | 0.64 | 0.0080 |
| NCAPD3 | 0.67 | 0.0145 | 0.64 | 0.0128 |
| NEXN | 0.54 | 0.0004 | 0.55 | 0.0003 |
| NFAT5 | 0.72 | 0.0320 | 0.70 | 0.0177 |
| NUDT6 | 0.66 | 0.0102 | . | . |
| OLFML3 | 0.56 | 0.0035 | 0.51 | 0.0011 |
| OMD | 0.61 | 0.0011 | 0.73 | 0.0357 |
| PAGE4 | 0.42 | <0.0001 | 0.36 | <0.0001 |
| PAK6 | 0.72 | 0.0335 | . | . |
| PCDHGB7 | 0.70 | 0.0262 | 0.55 | 0.0004 |
| PGF | 0.72 | 0.0358 | 0.71 | 0.0270 |
| PLP2 | 0.66 | 0.0088 | 0.63 | 0.0041 |
| PPAP2B | 0.44 | <0.0001 | 0.50 | 0.0001 |
| PPP1R12A | 0.45 | 0.0001 | 0.40 | <0.0001 |
| PRIMA1 | . | . | 0.63 | 0.0102 |
| PRKAR2B | 0.71 | 0.0226 | . | . |
| PRKCA | 0.34 | <0.0001 | 0.42 | <0.0001 |
| PRKCB | 0.66 | 0.0120 | 0.49 | <0.0001 |
| PROM1 | 0.61 | 0.0030 | . | . |
| PTEN | 0.59 | 0.0008 | 0.55 | 0.0001 |
| PTGER3 | 0.67 | 0.0293 | . | . |
| PTH1R | 0.69 | 0.0259 | 0.71 | 0.0327 |
| PTK2 | 0.75 | 0.0461 | . | . |
| PTK2B | 0.70 | 0.0244 | 0.74 | 0.0388 |
| PYCARD | 0.73 | 0.0339 | 0.67 | 0.0100 |
| RAD9A | 0.64 | 0.0124 | . | . |
| RARB | 0.67 | 0.0088 | 0.65 | 0.0116 |
| RGS10 | 0.70 | 0.0219 | . | . |
| RHOB | . | . | 0.72 | 0.0475 |
| RND3 | . | . | 0.67 | 0.0231 |
| SDHC | 0.72 | 0.0443 | . | . |
| SEC23A | 0.66 | 0.0101 | 0.53 | 0.0003 |
| SEMA3A | 0.51 | 0.0001 | 0.69 | 0.0222 |
| SH3RF2 | 0.55 | 0.0002 | 0.54 | 0.0002 |
| SLC22A3 | 0.48 | 0.0001 | 0.50 | 0.0058 |
| SMAD4 | 0.49 | 0.0001 | 0.50 | 0.0003 |
| SMARCC2 | 0.59 | 0.0028 | 0.65 | 0.0052 |
| SMO | 0.60 | 0.0048 | 0.52 | <0.0001 |
| SORBS1 | 0.56 | 0.0024 | 0.48 | 0.0002 |
| SPARCL1 | 0.43 | 0.0001 | 0.50 | 0.0001 |
| SRD5A2 | 0.26 | <0.0001 | 0.31 | <0.0001 |
| ST5 | 0.63 | 0.0103 | 0.52 | 0.0006 |
| STAT5A | 0.60 | 0.0015 | 0.61 | 0.0037 |
| STAT5B | 0.54 | 0.0005 | 0.57 | 0.0008 |
| SUMO1 | 0.65 | 0.0066 | 0.66 | 0.0320 |
| SVIL | 0.52 | 0.0067 | 0.46 | 0.0003 |
| TGFB1I1 | 0.44 | 0.0001 | 0.43 | 0.0000 |
| TGFB2 | 0.55 | 0.0007 | 0.58 | 0.0016 |
| TGFB3 | 0.57 | 0.0010 | 0.53 | 0.0005 |
| TIMP1 | 0.72 | 0.0224 | . | . |
| TIMP2 | 0.68 | 0.0198 | 0.69 | 0.0206 |
| TIMP3 | 0.67 | 0.0105 | 0.64 | 0.0065 |
| TMPRSS2 | . | . | 0.72 | 0.0366 |
| TNFRSF10A | 0.71 | 0.0181 | . | . |
| TNFSF10 | 0.71 | 0.0284 | . | . |
| TOP2B | 0.73 | 0.0432 | . | . |
| TP63 | 0.62 | 0.0014 | 0.50 | <0.0001 |
| TPM1 | 0.54 | 0.0007 | 0.52 | 0.0002 |
| TPM2 | 0.41 | <0.0001 | 0.40 | <0.0001 |
| TPP2 | 0.65 | 0.0122 | . | . |
| TRA2A | 0.72 | 0.0318 | . | . |
| TRAF3IP2 | 0.62 | 0.0064 | 0.59 | 0.0053 |
| TRO | 0.57 | 0.0003 | 0.51 | 0.0001 |
| VCL | 0.52 | 0.0005 | 0.52 | 0.0004 |
| VIM | 0.65 | 0.0072 | 0.65 | 0.0045 |
| WDR19 | 0.66 | 0.0097 | . | . |
| WFDC1 | 0.58 | 0.0023 | 0.60 | 0.0026 |
| ZFHX3 | 0.69 | 0.0144 | 0.62 | 0.0046 |
| ZNF827 | 0.62 | 0.0030 | 0.53 | 0.0001 |

Example 3: Identification of MicroRNAs Associated with Clinical Recurrence and Death Due to Prostate Cancer MicroRNAs function by binding to portions of messenger RNA (mRNA) and changing how frequently the mRNA is translated into protein. They can also influence the turnover of mRNA and thus how long the mRNA remains intact in the cell. Since microRNAs function primarily as an adjunct to mRNA, this study evaluated the joint prognostic value of microRNA expression and gene (mRNA) expression. Since the expression of certain microRNAs may be a surrogate for expression of genes that are not in the assessed panel, we also evaluated the prognostic value of microRNA expression by itself.

Patients and Samples

Samples from the 127 patients with clinical recurrence and 374 patients without clinical recurrence after radical prostatectomy described in Example 2 were used in this study. The final analysis set comprised 416 samples from patients in which both gene expression and microRNA expression were successfully assayed. Of these, 106 patients exhibited clinical recurrence and 310 did not have clinical recurrence. Tissue samples were taken from each prostate sample representing (1) the primary Gleason pattern in the sample, and (2) the highest Gleason pattern in the sample. In addition, a sample of histologically normal-appearing tissue adjacent to the tumor (NAT) was taken. The number of patients in the analysis set for each tissue type and the number of them who experienced clinical recurrence or death due to prostate cancer are shown in Table 14.

TABLE 14

Number of Patients and Events in Analysis Set

| | Patients | Clinical Recurrences | Deaths Due to Prostate Cancer |
|---|---|---|---|
| Primary Gleason Pattern Tumor Tissue | 416 | 106 | 36 |
| Highest Gleason Pattern Tumor Tissue | 405 | 102 | 36 |

TABLE 14-continued

Number of Patients and Events in Analysis Set

|  | Patients | Clinical Recurrences | Deaths Due to Prostate Cancer |
|---|---|---|---|
| Normal Adjacent Tissue | 364 | 81 | 29 |

Assay Method

Expression of 76 test microRNAs and 5 reference microRNAs were determined from RNA extracted from fixed paraffin-embedded (FPE) tissue. MicroRNA expression in all three tissue type was quantified by reverse transcriptase polymerase chain reaction (RT-PCR) using the crossing point ($C_p$) obtained from the Taqman® MicroRNA Assay kit (Applied Biosystems, Inc., Carlsbad, Calif.).

Statistical Analysis

Using univariate proportional hazards regression (Cox D R, Journal of the Royal Statistical Society, Series B 34:187-220, 1972), applying the sampling weights from the cohort sampling design, and using variance estimation based on the Lin and Wei method (Lin and Wei, Journal of the American Statistical Association 84:1074-1078, 1989), microRNA expression, normalized by the average expression for the 5 reference microRNAs hsa-miR-106a, hsa-miR-146b-5p, hsa-miR-191, hsa-miR-19b, and hsa-miR-92a, and reference-normalized gene expression of the 733 genes (including the reference genes) discussed above, were assessed for association with clinical recurrence and death due to prostate cancer. Standardized hazard ratios (the proportional change in the hazard associated with a change of one standard deviation in the covariate value) were calculated.

This analysis included the following classes of predictors:
1. MicroRNAs alone
2. MicroRNA-gene pairs Tier 1
3. MicroRNA-gene pairs Tier 2
4. MicroRNA-gene pairs Tier 3
5. All other microRNA-gene pairs Tier 4

The four tiers were pre-determined based on the likelihood (Tier 1 representing the highest likelihood) that the gene-microRNA pair functionally interacted or that the microRNA was related to prostate cancer based on a review of the literature and existing microarray data sets.

False discovery rates (FDR) (Benjamini and Hochberg, Journal of the Royal Statistical Society, Series B 57:289-300, 1995) were assessed using Efron's separate class methodology (Efron, Annals of Applied Statistics 2:197-223, 2008). The false discovery rate is the expected proportion of the rejected null hypotheses that are rejected incorrectly (and thus are false discoveries). Efron's methodology allows separate FDR assessment (q-values) (Storey, Journal of the Royal Statistical Society, Series B 64:479-498, 2002) within each class while utilizing the data from all the classes to improve the accuracy of the calculation. In this analysis, the q-value for a microRNA or microRNA-gene pair can be interpreted as the empirical Bayes probability that the microRNA or microRNA-gene pair identified as being associated with clinical outcome is in fact a false discovery given the data. The separate class approach was applied to a true discovery rate degree of association (TDRDA) analysis (Crager, Statistics in Medicine 29:33-45, 2010) to determine sets of microRNAs or microRNA-gene pairs that have standardized hazard ratio for clinical recurrence or prostate cancer-specific death of at least a specified amount while controlling the FDR at 10%. For each microRNA or microRNA-gene pair, a maximum lower bound (MLB) standardized hazard ratio was computed, showing the highest lower bound for which the microRNA or microRNA-gene pair was included in a TDRDA set with 10% FDR. Also calculated was an estimate of the true standardized hazard ratio corrected for regression to the mean (RM) that occurs in subsequent studies when the best predictors are selected from a long list (Crager, 2010 above). The RM-corrected estimate of the standardized hazard ratio is a reasonable estimate of what could be expected if the selected microRNA or microRNA-gene pair were studied in a separate, subsequent study.

These analyses were repeated adjusting for clinical and pathology covariates available at the time of patient biopsy: biopsy Gleason score, baseline PSA level, and clinical T-stage (T1-T2A vs. T2B or T2C) to assess whether the microRNAs or microRNA-gene pairs have predictive value independent of these clinical and pathology covariates.

Results

The analysis identified 21 microRNAs assayed from primary Gleason pattern tumor tissue that were associated with clinical recurrence of prostate cancer after radical prostatectomy, allowing a false discovery rate of 10% (Table 15). Results were similar for microRNAs assessed from highest Gleason pattern tumor tissue (Table 16), suggesting that the association of microRNA expression with clinical recurrence does not change markedly depending on the location within a tumor tissue sample. No microRNA assayed from normal adjacent tissue was associated with the risk of clinical recurrence at a false discovery rate of 10%. The sequences of the microRNAs listed in Tables 15-21 are shown in Table B.

TABLE 15

MicroRNAs Associated with Clinical Recurrence of Prostate Cancer
Primary Gleason Pattern Tumor Tissue

| MicroRNA | p-value | q-value[a] (FDR) | Direction of Association[b] | Absolute Standardized Hazard Ratio | | | |
|---|---|---|---|---|---|---|---|
| | | | | Uncorrected Estimate | 95% Confidence Interval | Max. Lower Bound @10% FDR | RM-Corrected Estimate[c] |
| hsa-miR-93 | <0.0001 | 0.0% | (+) | 1.79 | (1.38, 2.32) | 1.19 | 1.51 |
| hsa-miR-106b | <0.0001 | 0.1% | (+) | 1.80 | (1.38, 2.34) | 1.19 | 1.51 |
| hsa-miR-30e-5p | <0.0001 | 0.1% | (−) | 1.63 | (1.30, 2.04) | 1.18 | 1.46 |
| hsa-miR-21 | <0.0001 | 0.1% | (+) | 1.66 | (1.31, 2.09) | 1.18 | 1.46 |
| hsa-miR-133a | <0.0001 | 0.1% | (−) | 1.72 | (1.33, 2.21) | 1.18 | 1.48 |
| hsa-miR-449a | <0.0001 | 0.1% | (+) | 1.56 | (1.26, 1.92) | 1.17 | 1.42 |
| hsa-miR-30a | 0.0001 | 0.1% | (−) | 1.56 | (1.25, 1.94) | 1.16 | 1.41 |
| hsa-miR-182 | 0.0001 | 0.2% | (+) | 1.74 | (1.31, 2.31) | 1.17 | 1.45 |

TABLE 15-continued

MicroRNAs Associated with Clinical Recurrence of Prostate Cancer
Primary Gleason Pattern Tumor Tissue

| MicroRNA | p-value | q-value[a] (FDR) | Direction of Association[b] | Absolute Standardized Hazard Ratio | | | |
|---|---|---|---|---|---|---|---|
| | | | | Uncorrected Estimate | 95% Confidence Interval | Max. Lower Bound @10% FDR | RM-Corrected Estimate[c] |
| hsa-miR-27a | 0.0002 | 0.2% | (+) | 1.65 | (1.27, 2.14) | 1.16 | 1.43 |
| hsa-miR-222 | 0.0006 | 0.5% | (−) | 1.47 | (1.18, 1.84) | 1.12 | 1.35 |
| hsa-miR-103 | 0.0036 | 2.1% | (+) | 1.77 | (1.21, 2.61) | 1.12 | 1.36 |
| hsa-miR-1 | 0.0037 | 2.2% | (−) | 1.32 | (1.10, 1.60) | 1.07 | 1.26 |
| hsa-miR-145 | 0.0053 | 2.9% | (−) | 1.34 | (1.09, 1.65) | 1.07 | 1.27 |
| hsa-miR-141 | 0.0060 | 3.2% | (+) | 1.43 | (1.11, 1.84) | 1.07 | 1.29 |
| hsa-miR-92a | 0.0104 | 4.8% | (+) | 1.32 | (1.07, 1.64) | 1.05 | 1.25 |
| hsa-miR-22 | 0.0204 | 7.7% | (+) | 1.31 | (1.03, 1.64) | 1.03 | 1.23 |
| hsa-miR-29b | 0.0212 | 7.9% | (+) | 1.36 | (1.03, 1.76) | 1.03 | 1.24 |
| hsa-miR-210 | 0.0223 | 8.2% | (+) | 1.33 | (1.03, 1.70) | 1.00 | 1.23 |
| hsa-miR-486-5p | 0.0267 | 9.4% | (−) | 1.25 | (1.00, 1.53) | 1.00 | 1.20 |
| hsa-miR-19b | 0.0280 | 9.7% | (−) | 1.24 | (1.00, 1.50) | 1.00 | 1.19 |
| hsa-miR-205 | 0.0289 | 10.0% | (−) | 1.25 | (1.00, 1.53) | 1.00 | 1.20 |

[a]The q-value is the empirical Bayes probability that the microRNA's association with clinical recurrence is a false discovery, given the data.
[b]Direction of association indicates where higher microRNA expression is associated with higher (+) or lower (−) risk of clinical recurrence.
[c]RM: regression to the mean.

TABLE 16

MicroRNAs Associated with Clinical Recurrence of Prostate Cancer
Highest Gleason Pattern Tumor Tissue

| MicroRNA | p-value | q-value[a] (FDR) | Direction of Association[b] | Absolute Standardized Hazard Ratio | | | |
|---|---|---|---|---|---|---|---|
| | | | | Uncorrected Estimate | 95% Confidence Interval | Max. Lower Bound @10% FDR | RM-Corrected Estimate[c] |
| hsa-miR-93 | <0.0001 | 0.0% | (+) | 1.91 | (1.48, 2.47) | 1.24 | 1.59 |
| hsa-miR-449a | <0.0001 | 0.0% | (+) | 1.75 | (1.40, 2.18) | 1.23 | 1.54 |
| hsa-miR-205 | <0.0001 | 0.0% | (−) | 1.53 | (1.29, 1.81) | 1.20 | 1.43 |
| hsa-miR-19b | <0.0001 | 0.0% | (−) | 1.37 | (1.19, 1.57) | 1.15 | 1.32 |
| hsa-miR-106b | <0.0001 | 0.0% | (+) | 1.84 | (1.39, 2.42) | 1.22 | 1.51 |
| hsa-miR-21 | <0.0001 | 0.0% | (+) | 1.68 | (1.32, 2.15) | 1.19 | 1.46 |
| hsa-miR-30a | 0.0005 | 0.4% | (−) | 1.44 | (1.17, 1.76) | 1.13 | 1.33 |
| hsa-miR-30e-5p | 0.0010 | 0.6% | (−) | 1.37 | (1.14, 1.66) | 1.11 | 1.30 |
| hsa-miR-133a | 0.0015 | 0.8% | (−) | 1.57 | (1.19, 2.07) | 1.13 | 1.36 |
| hsa-miR-1 | 0.0016 | 0.8% | (−) | 1.42 | (1.14, 1.77) | 1.11 | 1.31 |
| hsa-miR-103 | 0.0021 | 1.1% | (+) | 1.69 | (1.21, 2.37) | 1.13 | 1.37 |
| hsa-miR-210 | 0.0024 | 1.2% | (+) | 1.43 | (1.13, 1.79) | 1.11 | 1.31 |
| hsa-miR-182 | 0.0040 | 1.7% | (+) | 1.48 | (1.13, 1.93) | 1.11 | 1.31 |
| hsa-miR-27a | 0.0055 | 2.1% | (+) | 1.46 | (1.12, 1.91) | 1.09 | 1.30 |
| hsa-miR-222 | 0.0093 | 3.2% | (−) | 1.38 | (1.08, 1.77) | 1.08 | 1.27 |
| hsa-miR-331 | 0.0126 | 3.9% | (+) | 1.38 | (1.07, 1.77) | 1.07 | 1.26 |
| hsa-miR-191* | 0.0143 | 4.3% | (+) | 1.38 | (1.06, 1.78) | 1.07 | 1.26 |
| hsa-miR-425 | 0.0151 | 4.5% | (+) | 1.40 | (1.06, 1.83) | 1.07 | 1.26 |
| hsa-miR-31 | 0.0176 | 5.1% | (−) | 1.29 | (1.04, 1.60) | 1.05 | 1.22 |
| hsa-miR-92a | 0.0202 | 5.6% | (+) | 1.31 | (1.03, 1.65) | 1.05 | 1.23 |
| hsa-miR-155 | 0.0302 | 7.6% | (−) | 1.32 | (1.00, 1.69) | 1.03 | 1.22 |
| hsa-miR-22 | 0.0437 | 9.9% | (+) | 1.30 | (1.00, 1.67) | 1.00 | 1.21 |

[a]The q-value is the empirical Bayes probability that the microRNA's association with death due to prostate cancer is a false discovery, given the data.
[b]Direction of association indicates where higher microRNA expression is associated with higher (+) or lower (−) risk of clinical recurrence.
[c]RM: regression to the mean.

Table 17 shows microRNAs assayed from primary Gleason pattern tissue that were identified as being associated with the risk of prostate-cancer-specific death, with a false discovery rate of 10%. Table 18 shows the corresponding analysis for microRNAs assayed from highest Gleason pattern tissue. No microRNA assayed from normal adjacent tissue was associated with the risk of prostate-cancer-specific death at a false discovery rate of 10%.

TABLE 17

MicroRNAs Associated with Death Due to Prostate Cancer
Primary Gleason Pattern Tumor Tissue

| | | | | Absolute Standardized Hazard Ratio | | | |
|---|---|---|---|---|---|---|---|
| MicroRNA | p-value | q-value[a] (FDR) | Direction of Association[b] | Uncorrected Estimate | 95% Confidence Interval | Max. Lower Bound @10% FDR | RM-Corrected Estimate[c] |
| hsa-miR-30e-5p | 0.0001 | 0.6% | (−) | 1.88 | (1.37, 2.58) | 1.15 | 1.46 |
| hsa-miR-30a | 0.0001 | 0.7% | (−) | 1.78 | (1.33, 2.40) | 1.14 | 1.44 |
| hsa-miR-133a | 0.0005 | 1.2% | (−) | 1.85 | (1.31, 2.62) | 1.13 | 1.41 |
| hsa-miR-222 | 0.0006 | 1.4% | (−) | 1.65 | (1.24, 2.20) | 1.12 | 1.38 |
| hsa-miR-106b | 0.0024 | 2.7% | (+) | 1.85 | (1.24, 2.75) | 1.11 | 1.35 |
| hsa-miR-1 | 0.0028 | 3.0% | (−) | 1.43 | (1.13, 1.81) | 1.08 | 1.30 |
| hsa-miR-21 | 0.0034 | 3.3% | (+) | 1.63 | (1.17, 2.25) | 1.09 | 1.33 |
| hsa-miR-93 | 0.0044 | 3.9% | (+) | 1.87 | (1.21, 2.87) | 1.09 | 1.32 |
| hsa-miR-26a | 0.0072 | 5.3% | (−) | 1.47 | (1.11, 1.94) | 1.07 | 1.29 |
| hsa-miR-152 | 0.0090 | 6.0% | (−) | 1.46 | (1.10, 1.95) | 1.06 | 1.28 |
| hsa-miR-331 | 0.0105 | 6.5% | (+) | 1.46 | (1.09, 1.96) | 1.05 | 1.27 |
| hsa-miR-150 | 0.0159 | 8.3% | (+) | 1.51 | (1.07, 2.10) | 1.03 | 1.27 |
| hsa-miR-27b | 0.0160 | 8.3% | (+) | 1.97 | (1.12, 3.42) | 1.05 | 1.25 |

[a]The q-value is the empirical Bayes probability that the microRNA's association with death due to prostate cancer endpoint is a false discovery, given the data.
[b]Direction of association indicates where higher microRNA expression is associated with higher (+) or lower (−) risk of death due to prostate cancer.
[c]RM: regression to the mean.

TABLE 18

MicroRNAs Associated with Death Due to Prostate Cancer
Highest Gleason Pattern Tumor Tissue

| | | | | Absolute Standardized Hazard Ratio | | | |
|---|---|---|---|---|---|---|---|
| MicroRNA | p-value | q-value[a] (FDR) | Direction of Association[b] | Uncorrected Estimate | 95% Confidence Interval | Max. Lower Bound @10% FDR | RM-Corrected Estimate[c] |
| hsa-miR-27b | 0.0016 | 6.1% | (+) | 2.66 | (1.45, 4.88) | 1.07 | 1.32 |
| hsa-miR-21 | 0.0020 | 6.4% | (+) | 1.66 | (1.21, 2.30) | 1.05 | 1.34 |
| hsa-miR-10a | 0.0024 | 6.7% | (+) | 1.78 | (1.23, 2.59) | 1.05 | 1.34 |
| hsa-miR-93 | 0.0024 | 6.7% | (+) | 1.83 | (1.24, 2.71) | 1.05 | 1.34 |
| hsa-miR-106b | 0.0028 | 6.8% | (+) | 1.79 | (1.22, 2.63) | 1.05 | 1.33 |
| hsa-miR-150 | 0.0035 | 7.1% | (+) | 1.61 | (1.17, 2.22) | 1.05 | 1.32 |
| hsa-miR-1 | 0.0104 | 9.0% | (−) | 1.52 | (1.10, 2.09) | 1.00 | 1.28 |

[a]The q-value is the empirical Bayes probability that the microRNA's association with clinical endpoint is a false discovery, given the data.
[b]Direction of association indicates where higher microRNA expression is associated with higher (+) or lower (−) risk of death due to prostate cancer.
[c]RM: regression to the mean.

Table 19 and Table 20 shows the microRNAs that can be identified as being associated with the risk of clinical recurrence while adjusting for the clinical and pathology covariates of biopsy Gleason score, baseline PSA level, and clinical T-stage. The distributions of these covariates are shown in FIG. 1. Fifteen (15) of the microRNAs identified in Table 15 are also present in Table 19, indicating that these microRNAs have predictive value for clinical recurrence that is independent of the Gleason score, baseline PSA, and clinical T-stage.

Two microRNAs assayed from primary Gleason pattern tumor tissue were found that had predictive value for death due to prostate cancer independent of Gleason score, baseline PSA, and clinical T-stage (Table 21).

TABLE 19

MicroRNAs Associated with Clinical Recurrence of Prostate Cancer
Adjusting for Biopsy Gleason Score, Baseline PSA Level, and Clinical T-Stage
Primary Gleason Pattern Tumor Tissue

| | | | | Absolute Standardized Hazard Ratio | | | |
|---|---|---|---|---|---|---|---|
| MicroRNA | p-value | q-value[a] (FDR) | Direction of Association[b] | Uncorrected Estimate | 95% Confidence Interval | Max. Lower Bound @10% FDR | RM-Corrected Estimate[c] |
| hsa-miR-30e-5p | <0.0001 | 0.0% | (−) | 1.80 | (1.42, 2.27) | 1.23 | 1.53 |
| hsa-miR-30a | <0.0001 | 0.0% | (−) | 1.75 | (1.40, 2.19) | 1.22 | 1.51 |
| hsa-miR-93 | <0.0001 | 0.1% | (+) | 1.70 | (1.32, 2.20) | 1.19 | 1.44 |
| hsa-miR-449a | 0.0001 | 0.1% | (+) | 1.54 | (1.25, 1.91) | 1.17 | 1.39 |
| hsa-miR-133a | 0.0001 | 0.1% | (−) | 1.58 | (1.25, 2.00) | 1.17 | 1.39 |
| hsa-miR-27a | 0.0002 | 0.1% | (+) | 1.66 | (1.28, 2.16) | 1.17 | 1.41 |
| hsa-miR-21 | 0.0003 | 0.2% | (+) | 1.58 | (1.23, 2.02) | 1.16 | 1.38 |
| hsa-miR-182 | 0.0005 | 0.3% | (+) | 1.56 | (1.22, 1.99) | 1.15 | 1.37 |
| hsa-miR-106b | 0.0008 | 0.5% | (+) | 1.57 | (1.21, 2.05) | 1.15 | 1.36 |
| hsa-miR-222 | 0.0028 | 1.1% | (−) | 1.39 | (1.12, 1.73) | 1.11 | 1.28 |
| hsa-miR-103 | 0.0048 | 1.7% | (+) | 1.69 | (1.17, 2.43) | 1.13 | 1.32 |
| hsa-miR-486-5p | 0.0059 | 2.0% | (−) | 1.34 | (1.09, 1.65) | 1.09 | 1.25 |
| hsa-miR-1 | 0.0083 | 2.7% | (−) | 1.29 | (1.07, 1.57) | 1.07 | 1.23 |
| hsa-miR-141 | 0.0088 | 2.8% | (+) | 1.43 | (1.09, 1.87) | 1.09 | 1.27 |
| hsa-miR-200c | 0.0116 | 3.4% | (+) | 1.39 | (1.07, 1.79) | 1.07 | 1.25 |
| hsa-miR-145 | 0.0201 | 5.1% | (−) | 1.27 | (1.03, 1.55) | 1.05 | 1.20 |
| hsa-miR-206 | 0.0329 | 7.2% | (−) | 1.40 | (1.00, 1.91) | 1.05 | 1.23 |
| hsa-miR-29b | 0.0476 | 9.4% | (+) | 1.30 | (1.00, 1.69) | 1.00 | 1.20 |

[a]The q-value is the empirical Bayes probability that the microRNA's association with clinical recurrence is a false discovery, given the data.
[b]Direction of association indicates where higher microRNA expression is associated with higher (+) or lower (−) risk of clinical recurrence.
[c]RM: regression to the mean.

TABLE 20

MicroRNAs Associated with Clinical Recurrence of Prostate Cancer
Adjusting for Biopsy Gleason Score, Baseline PSA Level, and Clinical T-Stage
Highest Gleason Pattern Tumor Tissue

| | | | | Absolute Standardized Hazard Ratio | | | |
|---|---|---|---|---|---|---|---|
| MicroRNA | p-value | q-value[a] (FDR) | Direction of Association[b] | Uncorrected Estimate | 95% Confidence Interval | Max. Lower Bound @10% FDR | RM-Corrected Estimate[c] |
| hsa-miR-30a | <0.0001 | 0.0% | (−) | 1.62 | (1.32, 1.99) | 1.20 | 1.43 |
| hsa-miR-30e-5p | <0.0001 | 0.0% | (−) | 1.53 | (1.27, 1.85) | 1.19 | 1.39 |
| hsa-miR-93 | <0.0001 | 0.0% | (+) | 1.76 | (1.37, 2.26) | 1.20 | 1.45 |
| hsa-miR-205 | <0.0001 | 0.0% | (−) | 1.47 | (1.23, 1.74) | 1.18 | 1.36 |
| hsa-miR-449a | 0.0001 | 0.1% | (+) | 1.62 | (1.27, 2.07) | 1.18 | 1.38 |
| hsa-miR-106b | 0.0003 | 0.2% | (+) | 1.65 | (1.26, 2.16) | 1.17 | 1.36 |
| hsa-miR-133a | 0.0005 | 0.2% | (−) | 1.51 | (1.20, 1.90) | 1.16 | 1.33 |
| hsa-miR-1 | 0.0007 | 0.3% | (−) | 1.38 | (1.15, 1.67) | 1.13 | 1.28 |
| hsa-miR-210 | 0.0045 | 1.2% | (+) | 1.35 | (1.10, 1.67) | 1.11 | 1.25 |
| hsa-miR-182 | 0.0052 | 1.3% | (+) | 1.40 | (1.10, 1.77) | 1.11 | 1.26 |
| hsa-miR-425 | 0.0066 | 1.6% | (+) | 1.48 | (1.12, 1.96) | 1.12 | 1.26 |
| hsa-miR-155 | 0.0073 | 1.8% | (−) | 1.36 | (1.09, 1.70) | 1.10 | 1.24 |
| hsa-miR-21 | 0.0091 | 2.1% | (+) | 1.42 | (1.09, 1.84) | 1.10 | 1.25 |
| hsa-miR-222 | 0.0125 | 2.7% | (−) | 1.34 | (1.06, 1.69) | 1.09 | 1.23 |
| hsa-miR-27a | 0.0132 | 2.8% | (+) | 1.40 | (1.07, 1.84) | 1.09 | 1.23 |
| hsa-miR-191* | 0.0150 | 3.0% | (+) | 1.37 | (1.06, 1.76) | 1.09 | 1.23 |
| hsa-miR-103 | 0.0180 | 3.4% | (+) | 1.45 | (1.06, 1.98) | 1.09 | 1.23 |
| hsa-miR-31 | 0.0252 | 4.3% | (−) | 1.27 | (1.00, 1.57) | 1.07 | 1.19 |
| hsa-miR-19b | 0.0266 | 4.5% | (−) | 1.29 | (1.00, 1.63) | 1.07 | 1.20 |
| hsa-miR-99a | 0.0310 | 5.0% | (−) | 1.26 | (1.00, 1.56) | 1.06 | 1.18 |
| hsa-miR-92a | 0.0348 | 5.4% | (+) | 1.31 | (1.00, 1.69) | 1.06 | 1.19 |

TABLE 20-continued

MicroRNAs Associated with Clinical Recurrence of Prostate Cancer
Adjusting for Biopsy Gleason Score, Baseline PSA Level, and Clinical T-Stage
Highest Gleason Pattern Tumor Tissue

| | | | | | Absolute Standardized Hazard Ratio | | |
|---|---|---|---|---|---|---|---|
| MicroRNA | p-value | q-value[a] (FDR) | Direction of Association[b] | Uncorrected Estimate | 95% Confidence Interval | Max. Lower Bound @10% FDR | RM-Corrected Estimate[c] |
| hsa-miR-146b-5p | 0.0386 | 5.8% | (−) | 1.29 | (1.00, 1.65) | 1.06 | 1.19 |
| hsa-miR-145 | 0.0787 | 9.7% | (−) | 1.23 | (1.00, 1.55) | 1.00 | 1.15 |

[a]The q-value is the empirical Bayes probability that the microRNA's association with clinical clinical recurrence is a false discovery, given the data.
[b]Direction of association indicates where higher microRNA expression is associated with higher (+) or lower (−) risk of clinical recurrence.
[c]RM: regression to the mean.

TABLE 21

MicroRNAs Associated with Death Due to Prostate Cancer
Adjusting for Biopsy Gleason Score, Baseline PSA Level, and Clinical T-Stage
Primary Gleason Pattern Tumor Tissue

| | | | | | Absolute Standardized Hazard Ratio | | |
|---|---|---|---|---|---|---|---|
| MicroRNA | p-value | q-value[a] (FDR) | Direction of Association[b] | Uncorrected Estimate | 95% Confidence Interval | Max. Lower Bound @10% FDR | RM-Corrected Estimate[c] |
| hsa-miR-30e-5p | 0.0001 | 2.9% | (−) | 1.97 | (1.40, 2.78) | 1.09 | 1.39 |
| hsa-miR-30a | 0.0002 | 3.3% | (−) | 1.90 | (1.36, 2.65) | 1.08 | 1.38 |

[a]The q-value is the empirical Bayes probability that the microRNA's association with clinical recurrence is a false discovery, given the data.
[b]Direction of association indicates where higher microRNA expression is associated with higher (+) or lower (−) risk of clinical recurrence.
[c]RM: regression to the mean.

Accordingly, the normalized expression levels of hsa-miR-93; hsa-miR-106b; hsa-miR-21; hsa-miR-449a; hsa-miR-182; hsa-miR-27a; hsa-miR-103; hsa-miR-141; hsa-miR-92a; hsa-miR-22; hsa-miR-29b; hsa-miR-210; hsa-miR-331; hsa-miR-191; hsa-miR-425; and hsa-miR-200c are positively associated with an increased risk of recurrence; and hsa-miR-30e-5p; hsa-miR-133a; hsa-miR-30a; hsa-miR-222; hsa-miR-1; hsa-miR-145; hsa-miR-486-5p; hsa-miR-19b; hsa-miR-205; hsa-miR-31; hsa-miR-155; hsa-miR-206; hsa-miR-99a; and hsa-miR-146b-5p are negatively associated with an increased risk of recurrence.

Furthermore, the normalized expression levels of hsa-miR-106b; hsa-miR-21; hsa-miR-93; hsa-miR-331; hsa-miR-150; hsa-miR-27b; and hsa-miR-10a are positively associated with an increased risk of prostate cancer specific death; and the normalized expression levels of hsa-miR-30e-5p; hsa-miR-30a; hsa-miR-133a; hsa-miR-222; hsa-miR-1; hsa-miR-26a; and hsa-miR-152 are negatively associated with an increased risk of prostate cancer specific death.

Table 22 shows the number of microRNA-gene pairs that were grouped in each tier (Tiers 1-4) and the number and percentage of those that were predictive of clinical recurrence at a false discovery rate of 10%.

TABLE 22

| Tier | Total Number of MicroRNA-Gene Pairs | Number of Pairs Predictive of Clinical Recurrence at False Discovery Rate 10% (%) |
|---|---|---|
| Tier 1 | 80 | 46 (57.5%) |
| Tier 2 | 719 | 591 (82.2%) |
| Tier 3 | 3,850 | 2,792 (72.5%) |
| Tier 4 | 54,724 | 38,264 (69.9%) |

TABLE A

| Official Symbol: | Accession Number: | SEQ ID NO | Forward Primer Sequence: | SEQ ID NO | Reverse Primer Sequence: | SEQ ID NO | Probe Sequence: | SEQ ID NO | Amplicon Sequence: |
|---|---|---|---|---|---|---|---|---|---|
| AAMP | NM_001087 | 1 | GTGTGGCAGGTGGACACTAA | 2 | CTCCATCCACTCCAGGTCTC | 3 | CGCTTCAAAGGACCCTCCTC GACCTCCTC | 4 | GTGTGGCAGGTGGACACTAAGGAGGAGGTCTG GTCCTTTGAAGCGGGAGACCTGGAGTGGATGG AG |
| ABCA5 | NM_172232 | 5 | GGTATGGATCCCAAAGCCA | 6 | CAGCCCGCTTTCTGTTTTA | 7 | CACATGTGGCGAGCA ATTCGAACT | 8 | GGTATGGATCCCAAAGCCAAACAGCACATGTG GCGAGCAATTCGAACTGCATTTAAAAACAGAA AGCGGGCT |
| ABCB1 | NM_000927 | 9 | AAACACCACTGAGCATTGA | 10 | CAAGCCTGGAACCTATAGCC | 11 | CAAGCCTGGAACCTA TAGCC | 12 | AAACACCACTGAGCATTGACTACCAGGCTCGC CAATGATGCTGCTCAAGTTAAAGGGGCTATAG GTTCCAG |
| ABCC1 | NM_004996 | 13 | TCATGGTGCCCGTCAATG | 14 | CGATTGTCTTTGCTCTTCATGTG | 15 | ACCTGATACGTCTTG GTCTTCATCGCCAT | 16 | TCATGGTGCCCGTCAATGCTGTGATGGCGATG AAGACCAAGACGTATCAGGTGGCCCACATGAA GAGCAAAG |
| ABCC3 | NM_003786 | 17 | TCATCCCTGGCGATCTACTTCCT | 18 | CCGTTGAGTGGAATCAGCAA | 19 | TCTGTCCTGGCTGGA GTCGCTTTCAT | 20 | TCATCCTGGCGATCTACTTCCTCTGGCAGAAC CTAGGTCCCCTGTCCTGGCTGGAGTCGCTTT CATGGTCTTTGCTGATTCCACTCAACGG |
| ABCC4 | NM_005845 | 21 | AGCGCCTGGAATCTACAACT | 22 | AGAGCCCCTGGAGAGAAGAT | 23 | CGGAGTCCAGTGTTT TCCCACTTA | 24 | AGCGCCTGGAATCTACAACTCGGAGTCCAGTG TTTCCCACTTATCATCTTCTCTCCAGGGGCT CT |
| ABCC8 | NM_000352 | 25 | CGTCTGTCACTGTGGAGTGG | 26 | TGATCCGGTTTAGCAGGC | 27 | AGTCTCTTGGCCACC TTCAGCCCT | 28 | CGTCTGTCACTGTGGAGTGGACAGGGGCTGAAG GTGGCCAAGAGACTGCACCCGCCAGCCTGCTAAA CCGGATCA |
| ABCG2 | NM_004827 | 29 | GGTCTCAACGCCATCCTG | 30 | CTTGGATCTTTCCTTGCAGC | 31 | ACGAAGATTTGCCTC CACCTGTGG | 32 | GGTCTCAACGCCATCCTGGGACCCACAGGTGG AGGCAAATCTTCGTTATTAGATGTTTAGCTG CAAGGAAAG |
| ABHD2 | NM_007011 | 33 | GTAGTGGGTCTGCATGGATGT | 34 | TGAGGGTTGGCACTCAGG | 35 | CAGGTGGTCTCCTTT GATCCTGA | 36 | GTAGTGGGTCTGCATGGATGTTTCAGGGATCA AAGGAGCCACCTGGGCGCCTGAGTGCCAACCC TCA |
| ACE | NM_000789 | 37 | CCCGCTGTACGAGGATTTCA | 38 | CCGTGTCTGTGAAGCCGT | 39 | TGCCCTCAGCAATGA AGCCTACAA | 40 | CCCGCTGTACGAGGATTTCACTGCCCTCAGCAA TGAAGCCTACAAGCAGGACGCGGCGTTCACAGACA CGG |
| ACOX2 | NM_003500 | 41 | ATGGAGGTGCCCAGAACAC | 42 | ACTCCGGGTAACTGTGGATG | 43 | TGCTCTCAACTTTCC TGCGGAGTG | 44 | ATGGAGGTGCCCAGAACACTGCACTCCGGAGG AAGTTGAGAGCATCATCCACAGTTACCCGGA GT |
| ACTR2 | NM_005722 | 45 | ATCCGCATTGAAGACCCA | 46 | ATCCGCTAGAACTGCACCAC | 47 | CCCGCAGAAAGCACA TGGTATTCC | 48 | ATCCGCATTGAAGACCCCAGAAAGCA CATGGTATTCCTGGGTGTGCAGTTCTAGCGG AT |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| ADAM15 | NM_003815 | 49 GGCGGGATGTGGT | 50 ATTTCTGGGCCTCCG | 51 TCAGCCACAATCACC AACTC | 52 GGCGGGATGTGGTAACAGAGACCAAGACTGTG GAGT |
| ADAMTS1 | NM_006988 | 53 GGACAGGTGCAAGCTCATCTG | 54 ATCTACAAACCTTGGGCTGCAA | 55 CAAGCCAAAGGCATT GGCTACTTCTTCG | 56 GGACAGGTGCAAGCTCATCTGCCAAGCCAAAG GCATTGGCTACTTCTTCGTTTGCAGCCCAAG GTTGTAGAT |
| ADH5 | NM_000671 | 57 ATGCTGTCATCATT | 58 CTGCTTCCTTTCCCTT | 59 TGTCTGCCCATTATC TTCAT | 60 ATGCTGTCATCATTGTCACGGTTTGTCTGCCC ATTAT |
| AFAP1 | NM_198595 | 61 GATGTCCATCCTT | 62 CAACCCTGATGCCTG | 63 CCTTCCAGTGCTGTGT TCCCA | 64 GATGTCCATCCTTGAAACAGCCCTCTTCTGGA ACACA |
| AGTR1 | NM_000685 | 65 AGCATTGATCGAT | 66 CTACAAGACATTGTGC | 67 ATTGTTCACCCAATG AAGTC | 68 AGCATTGATCGATACCTGGCTATTGTTCACCC AATGA |
| AGTR2 | NM_000686 | 69 ACTGGCATAGGAA | 70 ATTGACTGGGTCTCTT | 71 CCACCCAGACCCCAT GTAGC | 72 ACTGGCATAGGAAATGGTATCCAGAATGAAT TTTG |
| AIG1 | NM_016108 | 73 CGACGGTTCTGCC | 74 TGCTCCTGCTGGGAT | 75 AATGAGAGATGAGGAC ATCGC | 76 CGACGGTTCTGCCCTTTATATTAATCGAGATG AGGAC |
| AKAP1 | NM_003488 | 77 TGTGGTTGGAGAT | 78 GTCTACCCACTGGGC | 79 CTCCACAGGAGACCG GTTTA | 80 TGTGGTTGGAGATGAAGTGGTGTTGATAAACC GGTC |
| AKR1C1 | BC040210 | 81 GTGTGTGAAGCTG | 82 CTCTGCAGGCGCATA | 83 CCAAATCCCAGGACA GGCAT | 84 GTGTGTGAAGCTGAATGATGGTCACTTCATGC CTGTC |
| AKR1C3 | NM_003739 | 85 GCTTTGCCTGATGTCTACCAGAA | 86 GTCCAGTCACCGGCATAGAGA | 87 TGCGTCACCATCCAC ACACAGGG | 88 GCTTTGCCTGATGTCTACCAGAAGCCCTGTGT GTGGATGGTGACGCAGAGGACGTCTCTATGCC GGTGACTGG |
| AKT1 | NM_005163 | 89 CGCTTCTATGGCG | 90 TCCCGGTACACCACG | 91 CAGCCCCTGGACTAC TGCAC | 92 CGCTTCTATGGCGCTGAGTTGTGTCAGCCCT GGACT |
| AKT2 | NM_001626 | 93 TCCTGCCACCCTTC | 94 GGCCGTAAATTCATC | 95 CAGGTCACGTCCGAG GTCGA | 96 TCCTGCCACCCTTCAAACCTCAGTCACGTCC GAGGT |
| AKT3 | NM_005465 | 97 TTGTCTCTGCCTTGGACTATCTACA | 98 CCAGCATTAGATTCTCCAACTTGA | 99 TCACGGTACAACATC TTTCCGGA | 100 TTGTCTCTGCCTTGGACTATCTACATTCCGA AAGATTGTGTACCGTGATCTCAAGTTGGAGAA TCTAATGCTG |
| ALCAM | NM_001627 | 101 GAGGAAATATGGAA | 102 GTGGCGGAGATCAAG | 103 CCAGTTCCTGCCGTC TGCTC | 104 GAGGAAATATGGAATCAAGGGGCCAGTTCCT GCCG |
| ALDH18A1 | NM_002860 | 105 GATGCAGCTGGAACCCAA | 106 CTCCAGCTCAGTGGGAA | 107 CCTGAAACTTGCATC TCCTGCTGC | 108 GATGCAGCTGGAACCCAAGCTGCAGCAGAGA TGCAAGTTTCAGGATGTTCCCCACTGAGCTGG AG |

TABLE A-continued

| Official Symbol: | Accession Number: | SEQ ID NO | Forward Primer Sequence: | SEQ ID NO | Reverse Primer Sequence: | SEQ ID NO | Probe Sequence: | SEQ ID NO | Amplicon Sequence: |
|---|---|---|---|---|---|---|---|---|---|
| ALDH1A | NM_170696 | 109 | CACGTCTGTCCCT | 110 | GACCGTGGCTCAACT | 111 | TCTCTGTAGGGCCCA GCTCT | 112 | CACGTCTGTCCCTCTGCTTCTCTGTAGGG CCCAG |
| ALKBH3 | NM_139178 | 113 | TCGCTTAGTCTGC | 114 | TCTGAGCCCCAGTTTT | 115 | TAAACAGGGCAGTCA CTTTC | 116 | TCGCTTAGTCTGCACTCAACCGTGCGAAAG TGACT |
| ALOX12 | NM_000697 | 117 | AGTTCCTCAATGG | 118 | AGCACTAGCCTGGAG | 119 | CATGCTGTTGAGACG CTCGA | 120 | AGTTCCTCAATGTGCCAACCCCATGCTGTTG AGACG |
| ALOX5 | NM_000698 | 121 | GAGCTGCAGGACT | 122 | GAAGCCTGAGGACTT | 123 | CCGCATGCCGTACAC GTACA | 124 | GAGCTGCAGGACTTCGTGAACGATGCTACGT GTAC |
| AMACR | NM_203382 | 125 | GTCTCTGGGCTGTGTCAGCTTT | 126 | TGGGTATAAGATCCAGAACTTGC | 127 | TCCATGTGTTTGATT TCTCCTCAGGC | 128 | GTCTCTGGGCTGTCAGCTTTCCTTTCTCATG TGTTTGATTTCTCCTCAGGCTGTAGCAAGTT CTGGATCTTA |
| AMPD3 | NM_000480 | 129 | TGGTTCATCCAGCACAAGG | 130 | CATAAATCCCGGGCACCT | 131 | TACTCTCCCAAGCAT GCGCTGGATC | 132 | TGGTTCATCCAGCACAAGGTCTACTCTCCCAA CATGCGCTGGATCATCCAGGTGCCCGGATTT ATG |
| ANGPT2 | NM_001147 | 133 | CCGTGAAAGCTGC | 134 | TTGCAGTGGGAAGAA | 135 | AAGCTGACACAGCCC TCCCA | 136 | CCGTGAAAGCTGCTCTGTAAAGTGACACAG CCCT |
| ANLN | NM_018685 | 137 | TGAAAGTCCAAAA | 138 | CAGAACCAAGGCTAT | 139 | CCAAAGAACTCTGTGT CCCTC | 140 | TGAAAGTCCAAAACCAGGAAAATTCCAAAGAA CTCG |
| ANPEP | NM_001150 | 141 | CCACCTTGGACCAAAGTAAAGC | 142 | TCTCAGCCGTCACCTGGTAGGA | 143 | CTCCCCAACACGCTG AAACCCG | 144 | CCACCTTGGACCAAAGTAAAGCTGGAATCGT TACCGCCTCCCCAACACGCTGAAACCCGATTC CTACGGG |
| ANAX2 | NM_004039 | 145 | CAAGACACTAAGGGCGACTACCA | 146 | CGTGTCGGGCTTCAGTCAT | 147 | CCACCACACAGGTAC AGCAGCGCT | 148 | CAAGACACTAAGGGCGACTACCAGAAAGCGCT GCTGTACCTGTGTGTGGAGATGACTGAAGCC CGACACG |
| APC | NM_000038 | 149 | GGACAGCAGGAAT | 150 | ACCCACTCGATTGTT | 151 | CATTGCTCCCCGTG ACCTG | 152 | GGACAGCAGGAATGTGTTTCTCATACAGGT CACGG |
| APEX1 | NM_001641 | 153 | GATGAAGCCTTTC | 154 | AGGTCTCCACACAGC | 155 | CTTTCGGGAAGCCAG GCCCT | 156 | GATGAAGCCTTTCCCAAGTTCCTGAAGGCC TGGCTT |
| APOC1 | NM_001645 | 157 | CCAGCCTGATAAA | 158 | CACTCTGAATCCTTGC | 159 | AGGACAGGACCTCCC AACCA | 160 | CCAGCCTGATAAAGGTCCTGCGGGCAGGACA GGACC |
| APOE | NM_000041 | 161 | GCCTCAAGAGCTGGTTCG | 162 | CCTGCACCTTCTCCACCA | 163 | ACTGGGCTGCATGT CTTCCAC | 164 | GCCTCAAGAGCTGGTTCGAGCCCTGGTGGA AGACATGCAGCGCCAGTGGGCCGGGCTGTG GAGAAGGTGC |
| APRT | NM_000485 | 165 | GAGGTCCTGGAGT | 166 | AGGTGCCAGTTCTC | 167 | CCTTAAGCGAGGTCA GCTCC | 168 | GAGGTCCTGGAGTGCCTGAGCCTGGTGAGC TGACC |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| AQP2 | NM_000486 | 169 GTGTGGGTGCCAG | 170 CCCTTCAGCCCTCTCA | 171 CTCCTTCCCTTCCCC TTCTCC | 172 GTGTGGGTGCCAGTCCTCCTCAGGAGAAGGG GAAGG |
| AR | NM_000044 | 173 CGACTTCACCGCA | 174 TGACACAAGTGGGAC | 175 ACCATGCGCCAGGG TACCA | 176 CGACTTCACCGCACCTGATGTGTGGTACCCT GGCGG |
| ARF1 | NM_001658 | 177 CAGTAGAGATCCC | 178 ACAAGCACATGGCTA | 179 CTTGTCCTTGGGTCA CCCTG | 180 CAGTAGAGATCCCCGCAACTCCCAACTCGCTTGTCTT GGGTCA |
| ARHGAP29 | NM_004815 | 181 CACGGTCTCGTGTGAAGT | 182 CAGTTGCTTGCCCAGGAC | 183 ATGCCAGACCCAGAC AAAGCATCA | 184 CACGGTCTCGTGTGAAGTCAATGCCAGAC CAGACAAAGCATCAGCTTGTCCTGGGCAAGC AACTG |
| ARHGDI | NM_001175 | 185 TGGTCCCTAGAAC | 186 TGATGGAGGATCAGA | 187 TAAAACCGGCTTTC ACCCA | 188 TGGTCCCTAGAACAAGAGGCTTAAAACCGG CTTTC |
| ASAP2 | NM_003887 | 189 CGGCCCATCAGCT | 190 CTCTCGGCCAAAGATA | 191 CTGGGCTCCAACCAG CTTCA | 192 CGGCCCATCAGCTTCTACCAGCTCGGGCTCA ACCAG |
| ASPN | NM_017680 | 193 TGGACTAATCTGT | 194 AAAACACCCTTCAACA | 195 AGTATCACCCAGGGT GCAGC | 196 TGGACTAATCTGTGTGGAGCAGTTTATTCCAG TATCAC |
| ATM | NM_000051 | 197 TGCTTTTCTACACAT | 198 GTTGTGGATCGGCTC | 199 CCAGTCGTCTTCGAC ACTTC | 200 TGCTTTCTACACATGTTCAGGGATTTTCAC CAGCTG |
| ATP5E | NM_006886 | 201 CCGCTTTCGCTAC | 202 TGGGAGTATCGGATG | 203 TCCAGCCTGTCTCCA GTAGG | 204 CCGCTTTCGCTACAGCATGGTGCCTACTGG AGACA |
| ATP5J | NM_001003703 | 205 GTCGACCGACTGAAACGG | 206 CTCTACTTCCGGCCCCTGG | 207 CTACCCGCCATGCA ATGCATTAT | 208 GTCGACCGACTGAAACGGCGGCCCATAATGC ATTGCGATGGCGGGTAGGCGTGTGGGGCGG AGCCAGGGCC |
| ATXN1 | NM_000332 | 209 GATCGACTCCAGC | 210 GAACTGTATCACGGC | 211 CGGGCTATGGCTGTC TTCAA | 212 GATCGACTCCAGCCGTAGAGAGGATTGAA GACAG |
| AURKA | NM_003600 | 213 CATCTTCCAGGAG | 214 TCCCGACCTTCAATCAT | 215 CTCTGTGGCACCCTG GACTA | 216 CATCTTCCAGGAGGACCACTCTCTGTGGCAC CCTGGA |
| AURKB | NM_004217 | 217 AGCTGCGAAAGAG | 218 GCATCTGCCAACTCC | 219 TGACAGCAGCGAAC AGCC | 220 AGCTGCGAAAGAGCTGCACATTTGACAGCA GCGAA |
| AXIN2 | NM_004655 | 221 GGCTATGTCTTTG | 222 ATCCGTCAGCGCATC | 223 ACCAGCGCCAACGAC AGTG | 224 GGCTATGTCTTTGCACCAGCCACCAGCGCCA ACGAC |
| AZGP1 | NM_001185 | 225 GAGGCCAGCTAGG | 226 CAGGAAGGGCAGCTA | 227 TCTGAGATCCCACAT TGCCT | 228 GAGGCCAGCTAGGAAGCAAGGGTTGGAGGCA ATGTG |
| BAD | NM_032989 | 229 GGGTCAGGGGCCT | 230 CTGCTCACTCGGTC | 231 TGGGCCCAGAGCATG TTCCA | 232 GGGTCAGGGGCCTTCGAGATCGGGCTTGGGCC CAGAG |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| BAG5 | NM_001015049 | 233 ACTCCTGCAATGAACCCTGT | 234 ACAAACAGCTCCCCACGA | 235 ACACCGGATTAGCTCTTGTCGGC | 236 ACTCCTGCAATGAACCCTGTTAGCTCTTGTCGGCCTTCGTGGGAGCTGTTTGT |
| BAK1 | NM_001188 | 237 CCATTCCCACCATT | 238 GGGAACATAGACCCA | 239 ACACCCCAGACGTCCTGGCC | 240 CCATTCCCACCATTCTACCTGAGGCCAGACGTCTGG |
| BAX | NM_004324 | 241 CCGCCGTGGACAC | 242 TTGCCGTCAGAAAAC | 243 TGCCACTGCGGAAAAAGACCT | 244 CCGCCGTGGACACTCCCCGAGAGTCTTTTT |
| BBC3 | NM_014417 | 245 CCTGGAGGGTCCTGTACAAT | 246 CTAATTGGGCTCCATCTCG | 247 CATCATGGGACTCCTGCCCTTACC | 248 CCTGGAGGGTCCTGTACAATCTCATCATGGGACTCCTGCCCTTACCCAGGGGCCACAGACCCCCAGATGGA |
| BCL2 | NM_000633 | 249 CAGATGGACCTAGTACCCACTGAGA | 250 CCTATGATTTAAGGGCATTTTTCC | 251 TTCCACGCCGAAGGACAGCGAT | 252 CAGATGGACCTAGTACCCACTGAGATTTCCACGCCGAAGGACAGCGATGGGAAAAATGCCCTTAAATCATAG |
| BDKRB1 | NM_000710 | 253 GTGGCAGAAATCT | 254 GAAGGGCAAGCCCAA | 255 ACCTGCCAGCCTCTGACTCTG | 256 GTGGCAGAAATCTACCTGCCAACCTGGCAGCCTCT |
| BGN | NM_001711 | 257 GAGCTCCGCAAGG | 258 CTTGTTGTTCACCAGG | 259 CAAGGGTCTCCAGCACCTCT | 260 GAGCTCCGCAAGGATGACTTCAAGGGTCTCCAGCAC |
| BIK | NM_001197 | 261 ATTCCTATGGCTCTGCAATTGTC | 262 GGCAGGAGTGAATGCTCTTC | 263 CCGGTTAACTGTGGCCTGTGCCC | 264 ATTCCTATGGCTCTGCAATTGTCACCGGTAACTGTGGCCTGTGCCCAGGAAGAGCATTCACTCCTGCC |
| BIN1 | NM_004305 | 265 CCTGCAAAAGGGAACAAGAG | 266 CGTGTTGACTCTGATCTCG | 267 CTTCGCCTTCCAGATGGCTCCC | 268 CCTGCAAAAGGGAACAAGAGCCCTTCGCCTTCCAGATGGCTCCCTGCGCCCACCCCCGAGATCAGAGTCAAC |
| BIRC5 | NM_001012271 | 269 TTCAGGTGGATGAGGAGACA | 270 CACACAGCAGTGGCAAAAG | 271 TCTGCCAGACGCTTCCTATCACTCTATTC | 272 TTCAGGTGATGAGGAGACAGAATAGAGTGATAGGAAGCGTCTGGCAGATACTCCTTTTGCCACTGCTGTG |
| BMP6 | NM_001718 | 273 GTGCAGACCTTGG | 274 CTTAGTTGGCGCACA | 275 TGAACCCCGAGTATGTCCCCA | 276 GTGCAGACCTTGGTTCACCTTATGAACCCCGAGTATG |
| BMPR1B | NM_001203 | 277 ACCACTTTGGCCA | 278 GCGGTGTTTGTACCC | 279 ATTCACATTACCATAGCGGC | 280 ACCACTTTGGCCATCCCTGCATTTGGGCCGCTATGG |
| BRCA1 | NM_007294 | 281 TCAGGGGCTAGA | 282 CCATTCCAGTTGATCT | 283 CTATGGCCCTTCACCAACA | 284 TCAGGGGCTAGAAATCTGTTGCTATGGCCCTTCAC |
| BRCA2 | NM_000059 | 285 AGTTCGTGCTTTG | 286 AAGGTAAGCTGGGTC | 287 CATTCTTCACTGCTTCATAA | 288 AGTTCGTGCTTTGCAAGATGTGCAGAGTTTATGAA |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| BTG1 | NM_001731 | 289 GAGGTCCGAGCGA | 290 AGTTATTTTCGAGAC | 291 CGCTCGTCTCTTCCT CTCTC | 292 GAGGTCCGAGCGATGTGACCAGGCCGCCATC GCTCG |
| BTG3 | NM_006806 | 293 CCATATCGCCCAA | 294 CCAGTGATTCCGGTC | 295 CATGGGTACCTCCTC CTGGA | 296 CCATATCGCCCAATTCCAGTGACATGGGTAC CTCCTC |
| BTRC | NM_033637 | 297 GTTGGGACACAGT | 298 TGAAGCAGTCAGTTG | 299 CAGTCGGCCCAGGAC GGTCT | 300 GTTGGGACACAGTTGGTCTGCAGTCGGCCCA GGACG |
| BUB1 | NM_004336 | 301 CCGAGGTTAATCC | 302 AAGACATGCGCTCT | 303 TGCTGGGAGCCTACA CTTGG | 304 CCGAGGTTAATCCAGCACGTATGGGGCAAG TGTAG |
| C7 | NM_000587 | 305 ATGTCTGAGTGTG | 306 AGGCCTTATGCTGGT | 307 ATGCTCGCCCCTG CATCT | 308 ATGTCTGAGTGTGAGGCGGGCGCTCGAGAT GCAGA |
| CACNA1D | NM_000720 | 309 AGGACCCAGTCCAGCTCCATGTG | 310 CCTACATTCCGTGCCATTG | 311 CAGTACACTGGCGTC CATTCCCTG | 312 AGGACCCAGTCCATGTGCGTTCTCAGGGAA TGGACGCCAGTGTACTGCCAATGGCACGGAA TGTAGG |
| CADM1 | NM_014333 | 313 CCACCACCATCCT | 314 GATCCACTGCCCTGA | 315 TCTTCACCTGCTCGG GAATC | 316 CCACCACCATCCTTACCATCATCACAGATTC CCGAGC |
| CADPS | NM_003716 | 317 CAGCAAGGAGACT | 318 GGTCCTCTTCTCCACG | 319 CTCCTGGATGCCAA ATTTG | 320 CAGCAAGGAGACTGTGCTGAGCTCCTGGATG GCCAA |
| CASP1 | NM_001223 | 321 AACTGGAGCTGAG | 322 CATCTACGCTGTACC | 323 TCACAGGCATGACAA TGCTG | 324 AACTGGAGCTGAGGTTGACATCACAGGCATG ACAAT |
| CASP3 | NM_032991 | 325 TGAGCCTGAGCAG | 326 CCTTCCTGCCTGGTCC | 327 TCAGCCTGTTCCATG AAGGC | 328 TGAGCCTGAGCAGACATGACTCAGCCTGT TCCAT |
| CASP7 | NM_033338 | 329 GCAGCGCCGAGAC | 330 AGTCTCTTCCCGTCGC | 331 CTTTCCTAAAGGGG CCCCA | 332 GCAGCGCCGAGACTTTAGTTGTTCGCTTTCGC TAAAGG |
| CAV1 | NM_001753 | 333 GTGGCTCAACATT | 334 CAAATGGCCTCCATTTT | 335 ATTTCAGTCGATCAG TGGGC | 336 GTGGCTCAACATTGTGTTCCCATTTCAGCTG ATCAGT |
| CAV2 | NM_198212 | 337 CTTCCCTGGGACG | 338 CTCCTGGTCACCCTTC | 339 CCCGTACTGTCATGC CTCAG | 340 CTTCCCTGGGACGACTTGCCAGCTCTGAGGC ATGAC |
| CCL2 | NM_002982 | 341 CGCTCAGCCAGATGCAATC | 342 GCACTGAGATCTTCCTATTGGTGA A | 343 TGCCCCAGTCACCTG CTGTTA | 344 CGCTCAGCCAGATGCAATGCCCAGTC ACCTGCTGTTATAACTTCACCAATAGGAAGA TCTCAGTGC |
| CCL5 | NM_002985 | 345 AGGTTCTGAGCTC | 346 ATGCTGACTTCCTTCC | 347 ACAGAGCCCTGGCAA AGCC | 348 AGGTTCTGAGCTCTGGCTTTGCCTTGGCTTT GCCAGG |

TABLE A-continued

| Official Symbol: | Accession Number: | SEQ ID NO | Forward Primer Sequence: | SEQ ID NO | Reverse Primer Sequence: | SEQ ID NO | Probe Sequence: | SEQ ID NO | Amplicon Sequence: |
|---|---|---|---|---|---|---|---|---|---|
| CCNB1 | NM_031966 | 349 | TTCAGGTTGTTGCAGGAGAC | 350 | CATCTTCTTGGGCACACAAT | 351 | TGTCTTCCATTATTGATCGGTTCATGCA | 352 | TTCAGGTTGTTGCAGGAGACCATGTACTGACTGTCTTCCATTATTGATCGGTTCATGCAGAATAATTGTGTGCC |
| CCND1 | NM_001758 | 353 | GCATGTTCGTGGC | 354 | CGGTGTAGATGCACA | 355 | AAGGAGACCATCCCCCTGAC | 356 | GCATGTTCGTGGCCTTCAAGATGAAGGAGACCATCC |
| CCNE2 | NM_057749 | 357 | ATGCTGTGCTCCTTCCTAACT | 358 | ACCCAAATTGTGATATACAAAAGGTT | 359 | TACCAAGCAACCTACATGTCAAGAAGCCC | 360 | ATGCTGTGCTCCTTCCTAACTGGGCTTTCTTGACATGTAGGTTGCTTGGTAATAACCTTTTTGTATATCACA |
| CCNH | NM_001239 | 361 | GAGATCTTCGGTG | 362 | CTGCAGACGAGAACC | 363 | CATCAGCGTCGTCCTGGCGTAAA | 364 | GAGATCTTCGGTGGGGTACGGGTGTTTTACGCCAG |
| CCR1 | NM_001295 | 365 | TCCAAGACCCAAT | 366 | TCGTAGGCTTTCGTG | 367 | ACTCACCACACCTGCAGCCT | 368 | TCCAAGACCCAATGGGAATTCACTCACCACACCTGC |
| CD164 | NM_006016 | 369 | CAACCTGTGCGAA | 370 | ACACCCCAAGACCAGG | 371 | CCTCCAATGAAACTGGCTGC | 372 | CAACCTGTGCGAAAGTCTACCTTTGATGCAGCCAGTT |
| CD1A | NM_001763 | 373 | GGGAGTGGAAGGAACTGGAAA | 374 | TCATGGGCGTATCTACGAAT | 375 | CGCACCATTCCGTCATTTGAGG | 376 | GGAGTGGAAGGAACTGGAAACATTATTCCGTATACGCACCATTCCGTCATTTGAGGGAATTCGTAGATACGCC |
| CD276 | NM_001024736 | 377 | CCAAAGGATGCGATACACAG | 378 | GGATGACTTGGGAATCATGTC | 379 | CCACTGTGCAGCCTTATTTCTCCAATG | 380 | CCAAAGGATGCGATACACAGACCACTGTGCAGCCTTATTTCTCCAATGGACATGATTCCCAAGTCATCC |
| CD44 | NM_000610 | 381 | GGGCACCACTGCTT | 382 | GATGCTCATGGTGAA | 383 | ACTGGAACCCAGAAGCACA | 384 | GGCACCACTGCTTATGAAGGAAACTGGAACCAGAA |
| CD68 | NM_001251 | 385 | TGGTTCCCAGCCC | 386 | CTCCTCCACCCTGGGT | 387 | CTCCAAGCCCAGATTCAGAT | 388 | TGGTTCCCAGCCCTGTGTCCACCTCCAAGCCCAGATT |
| CD82 | NM_002231 | 389 | GTGCAGGCTCAGGTGAAGTG | 390 | GACCTTCAGGGCGATTCATGA | 391 | TCAGTTCTTACAACTGGACAGACAACGCTG | 392 | GTGCAGGCTCAGGTGAAGTGCTGCGGTGGGTCAGTTCTTACAACTGGACAGACAACGCTGAGCTCATGAAT |
| CDC20 | NM_001255 | 393 | TGGATTGGAGTTC | 394 | GCTTGCACTCCACAG | 395 | ACTGCCGTGGCACTGGACA | 396 | TGGATTGGAGTTCTGGGAATGTACTGGCCGTGGCAC |
| CDC25B | NM_021873 | 397 | GCTGCAGGACCAG | 398 | TAGGGCAGCTGGCTT | 399 | CTGCTACTCCCTTGCCTTT | 400 | GCTGCAGGACCAGTGAGGGCCTCGCGCCAGTCCTGC |
| CDC6 | NM_001254 | 401 | GCAACACTCCCCA | 402 | TGAGGGGGACCATTC | 403 | TTGTCTTCCACCAAAGCAAG | 404 | GCAACACTCCCCATTTACCTCCTTGTTCTCCACCAAA |
| CDH1 | NM_004360 | 405 | TGAGTGTCCCCCGTATCTTC | 406 | CAGCCGCTTTCAGATTTTCAT | 407 | TGCCAATCCCGATGAAATTGGAAATT | 408 | TGAGTGTCCCCCGTATCTTCCCGCCCTGCCAATCCCGATGAAATTGGAAATTTTATTGATGAAATCTGAAA |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| CDH10 | NM_006727 | 409 TGTGGTGCAAGTC | 410 TGTAAATGACTCTGG | 411 ATGCCGATGACCCTT CATAT | 412 TGTGGTGCAAGTCACAGTTACAGATGCCGAT GACCC |
| CDH11 | NM_001797 | 413 GTCGGCGAGAAGCA | 414 CTACTCATGGGCGGG | 415 CCTTCTGCCCATAGT GATCA | 416 GTCGGCAGAAGCAGGAGGACTTGTACCTTCTGCC CATAG |
| CDH19 | NM_021153 | 417 AGTACCATAATGC | 418 AGACTGCCTGTATAG | 419 ACTCGAAAACCACA AGCG | 420 AGTACCATAATGCCGGAACGCAAGACTCGA AAACC |
| CDH5 | NM_001795 | 421 ACAGGAGACGTGT | 422 CAGCAGTGAGGTGGT | 423 TATTCTCCCGTCCA GCCTC | 424 ACAGGAGACGTGTTCGCCATTGAGAGGCTGG ACCGG |
| CDH7 | NM_033646 | 425 GTTTGACATGGCT | 426 AGTCACATCCCTCCG | 427 ACCTCAACGTCATC GAGAC | 428 GTTTGACATGGCTGCACTGAGAAACCTCAAC GTCATC |
| CDK14 | NM_012395 | 429 GCAAGGTAAATGG | 430 GATAGCTGTGAAAGG | 431 CTTCCTGCAGCCTGA TCACC | 432 GCAAGGTAAATGGGAAGTTGGTAGCTCTGAA GGTGA |
| CDK2 | NM_001798 | 433 AATGCTGCACTACGACCCTA | 434 TTGGTCACATCCTGGAAGAA | 435 CCTTGGCCGAAATCC GCTTGT | 436 AATGCTGCACTACGACCCTAACAAGCGGATT TCGGCCAAGGCAGCCCTGGCTCACCCTTTCT TCCAGGATGTG |
| CDK3 | NM_001258 | 437 CCAGGAAGGGACT | 438 GTTGCATGAGCAGGT | 439 CTCTGGCTCCAGATT GGGCA | 440 CCAGGAAGGGACTGGAAGAGATTGTGCCAA TCTGG |
| CDK7 | NM_001799 | 441 GTCTCGGCGAAAG | 442 CTCTGGCCTTGTAAA | 443 CCTCCCCAAGGAAGT CCAGC | 444 GTTCGGGCAAAGCGTTATGAGAAGCTGAC TTCCT |
| CDKN1A | NM_000389 | 445 TGGAGACTCTCAG | 446 GGCGTTTGGAGTGGT | 447 CGGCGGCAGACCAGC ATGA | 448 TGGAGACTCTCAGGGTCGAAAACGGCGCAG ACCAG |
| CDKN1C | NM_000076 | 449 CGGCGATCAAGAA | 450 CAGGCGCTGATCTCT | 451 CGGGCTCTGATCTC CGATT | 452 CGGCGATCAAGAAGCTGTCCGGGCCTCTGAT CTCCG |
| CDKN2B | NM_004936 | 453 GACCCTGCAGAGC | 454 GCGGGAATCTCTCCT | 455 CACAGGATGCTGGCC TTTGC | 456 GACCCTGCAGAGCACCTTTGCACAGGATGCT GGCCT |
| CDKN2C | NM_001262 | 457 GAGCACTGGGCAA | 458 CAAAGGCGAACGGGA | 459 CCTGTAACTTGAGGG CCACC | 460 GAGCACTGGGCAATCGTTACGACCTGTAACT TGAGG |
| CDKN3 | NM_005192 | 461 TGGATCTCTACCA | 462 ATGTCAGGAGTCCCT | 463 ATCACCCATCATCAT CCAAT | 464 TGGATCTCTACCAGCAATGTGGAATTATCAC CCATCA |
| CDS2 | NM_003818 | 465 GGGCTTCTTTGCT | 466 ACAGGGCAGACAAAG | 467 CCCGGACATCACATA GGACA | 468 GGGCTTCTTTGCTACTGTGGTGTTTGGCTT CTGCTG |
| CENPF | NM_016343 | 469 CTCCCGTCAACAG | 470 GGGTGAGTCTGGCCT | 471 ACACTGGACCAGGAG TGCAT | 472 CTCCCGTCAACAGCGTTCTTTCCAAACACTG GACCAG |

TABLE A-continued

| Official Symbol: | Accession Number: | SEQ ID NO | Forward Primer Sequence: | SEQ ID NO | Reverse Primer Sequence: | SEQ ID NO | Probe Sequence: | SEQ ID NO | Amplicon Sequence: |
|---|---|---|---|---|---|---|---|---|---|
| CHAF1A | NM_005483 | 473 | GAACTCAGTGTAT | 474 | GCTCTGTAGCACCTG | 475 | TGCACGTACCAGCACATCCT | 476 | GAACTCAGTGTATGAGAAGCGGCTGACTTCAGGAT |
| CHN1 | NM_001822 | 477 | TTACGACGCTCGT | 478 | TCTCCCTGATGCACAT | 479 | CCACCATTGGCCGCTTAGTG | 480 | TTACGACGCTCGTGAAAGCACATACCACTAAGCGGC |
| CHRAC1 | NM_017444 | 481 | TCTCGCTGCCTCTA | 482 | CCTGGTTGATGCTGG | 483 | ATCCGGGTCATCATGAAGAG | 484 | TCTCGCTGCCTCTATCCCGCATCCGGGTCATCATGAA |
| CKS2 | NM_001827 | 485 | GGCTGGACGTGGT | 486 | CGCTGCAGAAAATGA | 487 | CTGCGCCCGCTCTTCGCG | 488 | GGCTGGACGTGGTTTTGTCTGCTGCCCGCTCTTCG |
| CLDN3 | NM_001306 | 489 | ACCAACTGCGTGC | 490 | GGCGAGAAGGAACAG | 491 | CAAGGCCAAGATCACCATCG | 492 | ACCAACTGCGTGCAGGACGACACGGCCAAGGCCAAG |
| CLTC | NM_004859 | 493 | ACCGTATGGACAG | 494 | TGACTACAGGATCAG | 495 | TCTCCATGCTGTACCCAAA | 496 | ACCGTATGGACAGCCACAGCCTGCTTTGGGTACAG |
| COL11A1 | NM_001854 | 497 | GCCCAAGAGGGGA | 498 | GGAACCTGGGTCTCCA | 499 | CTGCTCGACCTTTGGGTCCT | 500 | GCCCAAGAGGGGAAGATGGCCCTGAAGGACCCAAAG |
| COL1A1 | NM_000088 | 501 | GTGGCCATCCAGC | 502 | CAGTGGTAGGTGATG | 503 | TCCTGCGCCTGATGTCCACC | 504 | GTGGCCATCCAGCTGACCTTCCTGCGCCTGATGTCCA |
| COL1A2 | NM_000089 | 505 | CAGCCAAGAACTGTATAGGAGCT | 506 | AAAACTGGCTGCCAGCATTG | 507 | TCTCCTAGCCAGACGTGTTTCTTGTCCTTG | 508 | CAGCCAAGAACTGTATAGGAGCTCCAAGACAAGAAACACGTCTGGCTAGGAGAAACTATCAATGCTGGCA |
| COL3A1 | NM_000090 | 509 | GGAGGTTCTGGAC | 510 | ACCAGGACTGCCACG | 511 | CTCCTGTCCCCAAGGTGTC | 512 | GGAGGTTCTGGACCTGCTGGTCCTCCTGTCCCAAG |
| COL4A1 | NM_001845 | 513 | ACAAAGGCCTCCC | 514 | GAGTCCCAGGAAGAC | 515 | CTCCTTTGACACCAGGGATG | 516 | ACAAAGGCCTCCCCAGGATTGGATGGCATCCTGGTG |
| COL5A1 | NM_000093 | 517 | CTCCCTGGGAAAG | 518 | CTGGACCAGGAAGCC | 519 | CCAGGGAAACCACGTGTGGT | 520 | CTCCCTGGGAAAGATGGCCCTCCAGGATTACGTGGT |
| COL5A2 | NM_000393 | 521 | GGTCGAGGAACCC | 522 | GCCTGGAGGTCCAAC | 523 | CCAGGAAATCCTGTAGCACC | 524 | GGTCGAGGAACCCAAGGTCCGCCTGGTGCTACAGGA |
| COL6A1 | NM_001848 | 525 | GGAGACCCTGGTG | 526 | TCTCCAGGGACACCA | 527 | CTTTCTTTCCCTGATCACCC | 528 | GGAGACCCTGGTGAAGCTGGCCCCAGGGTGATCAG |
| COL6A3 | NM_004369 | 529 | GAGAGCAAGCGAG | 530 | AACAGGGAACTGGCC | 531 | CCTCTTTGACGCTCAGCGCT | 532 | GAGAGCAAGCGAGACATTCTGTCCTCTTTGACGGCT |
| COL8A1 | NM_001850 | 533 | TGGTGTTCCAGGG | 534 | CCCTGTAAACCCTGA | 535 | CCTAAGGGAGCCAGGAA | 536 | TGGTGTTCCAGGGCTTCTCGGACCTAAGGAGAGCC |

TABLE A-continued

| Official Symbol: | Accession Number: | SEQ ID NO | Forward Primer Sequence: | SEQ ID NO | Reverse Primer Sequence: | SEQ ID NO | Probe Sequence: | SEQ ID NO | Amplicon Sequence: |
|---|---|---|---|---|---|---|---|---|---|
| COL9A2 | NM_001852 | 537 | GGGAACCATCCAG | 538 | ATTCCGGGTGGACAG | 539 | ACACAGGAAATCCGCACTGC | 540 | GGGAACCATCCAGGTCTGGAAGGCAGTGCGGATT |
| CRISP3 | NM_006061 | 541 | TCCCTTATGAACA | 542 | AACCATTGGTGCATA | 543 | TGCCAGTTGCCCAGATAACT | 544 | TCCCTTATGAACAAGGAGCACCTTGTGCCAGTTGCCC |
| CSF1 | NM_000757 | 545 | TGCAGCGGCTGATTGACA | 546 | CAACTGTTCCTGGTCTACAAACTCA | 547 | TCAGATGGAGACCTCGTGCCAAATTACA | 548 | TGCAGCGGCTGATTGACAGTCAGATGGAGACCTCGTGCCAAATTACATTTGAGTTTGTAGACCAGGAACAGTT |
| CSK | NM_004383 | 549 | CCTGAACATGAAG | 550 | CATCACGTCTCCGAA | 551 | TCCCGATGGTGTCTGCAGCAGC | 552 | CCTGAACATGAAGGAGCTGAAGCTGCTGCAGACCAT |
| CSRP1 | NM_004078 | 553 | ACCCAAGACCCTG | 554 | GCAGGGGTGGAGTGA | 555 | CCACCCTTCTCCAGGGACCCC | 556 | ACCCAAGACCCTGCCTCTTCCACTCCACCCTTCTCCA |
| CTGF | NM_001901 | 557 | GAGTTCAAGTGCCCCTGACG | 558 | AGTTGTAATGGCAGGCACAG | 559 | AACATCATGTTCTTCTTCATGACCTGCGC | 560 | GAGTTCAAGTGCCCTGACGGAGTCATGAAGAAGACATGATGTTCATCAAGACCTGTGCCTGCCATTACA |
| CTHRC1 | NM_138455 | 561 | TGGCTCACTTCGG | 562 | TCAGCTCCATTGAAT | 563 | CAACGCTGACAGCATGCATT | 564 | TGGCTCACTTCGGCTAAAATGCAGAAATGCATGCTGT |
| CTNNA1 | NM_001903 | 565 | CGTTCCGATCCTCCTATACTGCAT | 566 | AGGTCCCGTTGGCCTTATAGG | 567 | ATGCCTACAGCAGCACCCTGATGTCGCA | 568 | CGTTCCGATCCTCCTATACTGCATGCCTACAGCAGCACCCTGATGTCGCAGCCTATAAGGCCAACAGG |
| CTNNB1 | NM_001904 | 569 | GGCTCTTGTGCGTACTGTCCTT | 570 | TCAGATGACGAAGAGCACAGATG | 571 | AGGCTCAGTGATGTCTTCCCGTCACCAG | 572 | GGCTCTTGTGCGTACTGTCCTTGACAGGGAAGACATCACTGAGCCTGCCATCTGTGCTCTTCGTC |
| CTNND1 | NM_001331 | 573 | CGGAAACTTCGGG | 574 | CTGAATCCTTCTCTGCCC | 575 | TTGATGCCCCTCATTTCATT | 576 | CGGAAACTTCGGGAATGTGATGTTAGTTGATGCC |
| CTNND2 | NM_001332 | 577 | GCCCGTCCCTACA | 578 | CTCACACCCAGGAGT | 579 | CTATGAAACGAGCCACTACC | 580 | GCCCGTCCCTACAGTGACTGAACTATGAAACGAGC |
| CTSB | NM_001908 | 581 | GGCCGAGATCTAC | 582 | GCAGGAAGTCCGAAT | 583 | CCCCGTTGGAGGGAGCTTTCT | 584 | GGCCGAGATCTACAAAAACGGCCCGGAGGGAGC |
| CTSD | NM_001909 | 585 | GTACATGATCCCCTGTGAGAAGGT | 586 | GGGACAGCTTGTAGCCTTTGC | 587 | ACCCTGCCCCGCGATCACACTGA | 588 | GTACATGATCCCCTGTGAGAAGGTGTCCACCTGCCCCGCGATCACACTGAAGCTGGGAGGCAAAGGCTACAAG |
| CTSK | NM_000396 | 589 | AGGCTTCTCTTGG | 590 | CCACCCTTCTCACTGGT | 591 | CCCCAGGTGGTTCATAGCCA | 592 | AGGCTTCTCTTGGTGTCCATACATATGAACTGGCTAT |
| CTSL2 | NM_001333 | 593 | TGTCTCACTGAGC | 594 | ACCATTGCAGCCCTG | 595 | CTTGAGGACCGAACAGTCC | 596 | TGTCTCACTGAGCCAGCAGAATTGGTGACTGTTC |

TABLE A-continued

| Official Symbol: | Official Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| CTSS | NM_004079 | 597 TGACAACGGCTTT | 598 TCCATGGCTTTGTAG | 599 TGATAACAAGGCCAT CGACT | 600 TGACAACGGCTTTCCAGTACATCATTGATAA CAAGG |
| CUL1 | NM_003592 | 601 ATGCCCTGTAAT | 602 GCGACCACAAGCCTT | 603 CAGCCACAAAGCCAG CGTCA | 604 ATGCCCTGTAATGCTGCATTCAACAATGA CGTGG |
| CXCL12 | NM_000609 | 605 GAGCTACAGATGC | 606 TTTGAGATGCTTGAC | 607 TTCTTCGAAAGCCAT GTTGC | 608 GAGCTACAGATGCCCATGCCGATTCTTCGAA AGCCA |
| CXCR4 | NM_003467 | 609 TGACCGCTTCTAC | 610 AGGATAAGGCCAACC | 611 CTGAAACTGGAACAC AACCA | 612 TGACCGCTTCTACCCCAATGACTTGTGGGTG GTTGTG |
| CXCR7 | NM_020311 | 613 CGCCTCAGAACGATGGAT | 614 GTTGCATGGCCAGCTGAT | 615 CTCAGAGCCAGGAA CTTCTCGA | 616 CGCCTCAGAACGATGGATCTGCATCTTCG ACTACTCAGAGCCAGGAACTTCTCGGACAT CAGCTGGCCAT |
| CYP3A5 | NM_000777 | 617 TCATTGCCCAGTA | 618 GACAGGCTTGCCTTT | 619 TCCCGCCTCAAGTTT CTCAC | 620 TCATTGCCCAGTATGGAGATGTATTGGTGAG AAACTT |
| CYR61 | NM_001554 | 621 TGCTCATTCTTGAG | 622 GTGGCTGCATTAGTG | 623 CAGCACCCCTTGGCAG TTTCG | 624 TGCTCATTCTTGAGGAGCATTAAGGTATTTC GAAACT |
| DAG1 | NM_004393 | 625 GTGACTGGGCTCA | 626 ATCCCACTTGTGCTCC | 627 CAAGTCAGAGTTTCC CTGGT | 628 GTGACTGGGCTCATGCCTCCAAGTCAGATT TCCCTG |
| DAP | NM_004394 | 629 CCAGCCTTTCTGG | 630 GACCAGGTCTGCCTC | 631 CTCACCAGCTGGCAG ACGTG | 632 CCAGCCTTTCTGTGTCTTCTCCAGTCAC GTCGC |
| DAPK1 | NM_004938 | 633 CGCTGACATCATG | 634 TCTCTTTCAGCAACGA | 635 TCATATCCAAACTCG CCTCC | 636 CGCTGACATCATGAATGTTCCTGACCGGCT GGAGG |
| DARC | NM_002036 | 637 GCCCTCATTAGTC | 638 CAGACAGAAGGGCTG | 639 TCAGCCGCCTGTGCTT CCAAG | 640 GCCCTCATTAGTCCTTGGCTCTTTATCTTGA AGCACA |
| DDIT4 | NM_019058 | 641 CCTGGCGTCTGTC | 642 CGAGAGAGGAGGTGGA | 643 CTAGCCTTTGGGACC GCTTC | 644 CCTGGCGTCTGTCCTCCACCATGCCTAGCCTT TGGGAC |
| DDR2 | NM_001014796 | 645 CTATTACCGGATCCAGGGC | 646 CCCCAGCCAAGATACTCTCCCA | 647 AGTGCTCCCTATCCG CTGGATGTC | 648 CTATTACCGGATCCAGGGCCGGGCAGTGCTC CCTATCCGCTGGATGTCTTGGGAGTATCT TGCTGGGG |
| DES | NM_001927 | 649 ACTTCTCACTGGC | 650 GCTCCACCTTCTCGTT | 651 TGAACCAGGAGTTTC TGACC | 652 ACTTCTCACTGGGCCGACGGGTGAACCAGGA GTTTCT |
| DHRS9 | NM_005771 | 653 GGAGAAAGTGTCTC | 654 CAGTCAGTGGGAGCC | 655 ATCAATAAATGCTGGT GTTCC | 656 GGAGAAAGTCTCTGGGGCTGATCAATAAT GCTGG |
| DHX9 | NM_001357 | 657 GTTCGAACCATCT | 658 TCCAGTTGGATTGTG | 659 CCAAGGAACCACACC CACTT | 660 GTTCGAACCATCTCAGGCGACAAAACCAAGTG GGTGT |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| DIAPH1 | NM_005219 | 661 CAAGCAGTCAAGG | 662 AGTTTGCTCGCCTCA | 663 TTCTTCTGTCTCCCGCCGCT | 664 CAAGCAGTCAAGGAGAACCAGAAGCGGGCGGGAGAC |
| DICER1 | NM_177438 | 665 TCCAATTCCAGCA | 666 GGCAGTGAAGGCGAT | 667 AGAAAAGTCGTTTGTCTCCC | 668 TCCAATTCCAGCATCACTGTGAGAAAAGCTGTTTGT |
| DIO2 | NM_013989 | 669 CTCCTTTCACGAG | 670 AGGAAGTCAGCCACT | 671 ACTCTTCCACCAGTTTGCGG | 672 CTCCTTTCACGAGCCAGTCAGTCTGCCAGCCTTCCGCAAACT |
| DLC1 | NM_006094 | 673 GATTCAGACGAGG | 674 CACCTCTTGCTGTCC | 675 AAAGTCCATTTGCCACTGAT | 676 GATTCAGACGAGGATGAGCCTTGTGCCATCAGTGGC |
| DLGAP1 | NM_004746 | 677 CTGCTGAGCCCAG | 678 AGCCTGGAAGGAGTT | 679 CGCAGACCACCCATACTACA | 680 CTGCTGAGCCCAGTGGAGCACCCCGCAGACCAC |
| DLL4 | NM_019074 | 681 CACGGAGGTATAA | 682 AGAAGGAAGTCCAG | 683 CTACCTGGACATCCCTGCTC | 684 CACGGAGGTATAAGGCAAGAGCCTACCTGGACATCC |
| DNM3 | NM_015569 | 685 CTTTCCCACCCGG | 686 AAGGACCTTCTGCAG | 687 CATATCGCTGACCGAATGGG | 688 CTTTCCCACCCGGCTTACAGACATATCGCTGACCGAA |
| DPP4 | NM_001935 | 689 GTCCTGGGATCGG | 690 GTACTCCCACCGGGA | 691 CGGCTATTCCACACTTGAAC | 692 GTCCTGGGATCGGGAAGTGGCGTGTTCAAGTGTGGA |
| DPT | NM_001937 | 693 CACCTAGAAGCCT | 694 CAGTAGCTCCCCAGG | 695 TTCCTAGGAAGGCTGCAGA | 696 CACCTAGAAGCCTGCCCACGATTCCTAGGAAGGCTG |
| DUSP1 | NM_004417 | 697 AGACATCAGCTCC | 698 GACAAACACCCTTCC | 699 CGAGGCCATTGACTTCATAG | 700 AGACATCAGCTCCTCCTGGTTCAACGAGGCCATTGACTTC |
| DUSP6 | NM_001946 | 701 CATGCAGGGACTG | 702 TGCTCCTACCCTATCA | 703 TCTACCCTATGCGCCTGGAA | 704 CATGCAGGGACTGGGATTCGAGGACTTCCAGGCGCA |
| DVL1 | NM_004421 | 705 TCTGTCCCACCTG | 706 TCAGACTGTTGCCGG | 707 CTTGGAGCAGCCTGCACCTT | 708 TCTGTCCCACCTGCTGCCCCTTGGAGCAGCCTGC |
| DYNLL1 | NM_001037494 | 709 GCCGCCTACCTCACAGAC | 710 GCCTGACTCCAGCTCTCCT | 711 ACCCAGTCAGTGAGTGCTCACAA | 712 GCCGCCTACCTCACAGACTGTGAGCACTCACTGACGTGGGTAGCCCCAGGGCCTGCGGGGCGCAGGAGAG |
| EBNA1BP2 | NM_006824 | 713 TGCGGGCGAGATGACACT | 714 GTGACAAGGGATTCATCGGATT | 715 CCCGCTCTCGGATTCGGAGTCG | 716 TGCGGGCGAGATGACACTCCCCGCTCTCGGATTCGGAGTCGGAATCCGATGAATCCCTTGTCAC |
| ECE1 | NM_001397 | 717 ACCTTGGGATCTG | 718 GGACCAGGACCTCCA | 719 TCCACTCTCGATACCCTGCA | 720 ACCTTGGGATCTGCCTCCAAGCTGTGCAGGGTATC |
| EDN1 | NM_001955 | 721 TGCCACCTGGACA | 722 TGGACCTAGGGCTTC | 723 CACTCCCGAGCACGTTGTTC | 724 TGCCACCTGGACATCATTTGGGTCAACTCCCGAGC |

TABLE A-continued

| Official Symbol: | Accession Number: | SEQ ID NO | Forward Primer Sequence: | SEQ ID NO | Reverse Primer Sequence: | SEQ ID NO | Probe Sequence: | SEQ ID NO | Amplicon Sequence: |
|---|---|---|---|---|---|---|---|---|---|
| EDNRA | NM_001957 | 725 | TTTCCTCAAATTTG | 726 | TTACACATCCAACCA | 727 | CCTTTGCCTCAGGGCATCCT | 728 | TTTCCTCAAATTTGCCTCAAGATGGAAACCCTTTGCC |
| EFNB2 | NM_004093 | 729 | TGACATTATCATCCCGCTAAGGA | 730 | GTAGTCCCCGCTGACCTTCTC | 731 | CGGACAGCGTCTTCTGCCCTCACT | 732 | TGACATTATCATCCCGCTAAGGACTGCGACAGCGTCTTCTGCCCTCACTACGACGAAGGTCAGCGGGACTA |
| EGF | NM_001963 | 733 | CTTTGCCTTGCTCTGTCACAGT | 734 | AAATACCTGACACCCTTATGACAAATT | 735 | AGAGTTAACAGCCCTGCTCTGGCTGACTT | 736 | CTTTGCCTTGCTCTGTCACAGTGAAGTCAGCCAGAGCAGGGCTGTTAAACTCTGTGAAATTTGTCATAAGGGTG |
| EGR1 | NM_001964 | 737 | GTCCCCGCTGCAGATCTCT | 738 | CTCCAGCTTAGGGTAGTTGTCCAT | 739 | CGGATCCTTTCCTCACTCGCCCA | 740 | GTCCCCGCTGCAGATCTCTGACCCGTTCGATCCTTTCCTCACTCGCCCACCATGGACAACTACCCTAAGCTGG |
| EGR3 | NM_004430 | 741 | CCATGTGGATGAATGAGAGTG | 742 | TGCCTGAGAGAGGTGAGGT | 743 | ACCCAGTCCTCACCTTCTCCCCACC | 744 | CCATGTGGATGAATGAGAGTGTCTCCTTTCCATACCCAGTCCTCACCTTCTCCCCACCTCACCTCTCTCA |
| EIF2C2 | NM_012154 | 745 | GCACTGTGTGGGCAG | 746 | ATGTTTGGTGACTGG | 747 | CGGGTCACAATTGCAGACACG | 748 | GCACTGTGGGCAGATGCAGGAGGAGTACCGCGTCTG |
| EIF2S3 | NM_001415 | 749 | CTGCCTCCCTGATT | 750 | GGTGGCAAGTGCCTG | 751 | TCTCGTGCTTCAGCCTCCCA | 752 | CTGCCTCCCTGATTCAAGTGATTCTCGTGCTTCAGCC |
| EIF3H | NM_003756 | 753 | CTCATTGCAGGCCAGATAAA | 754 | GCCATGAAGAGCTTGCCTA | 755 | CAGAACATCAAGGAGTTCACTGCCCA | 756 | CTCATTGCAGGCCAGATAAACATTACTGCCAGAACATCAAGGAGTTCACTGCCCAAAACTTAGGCAAGCTC |
| EIF4E | NM_001968 | 757 | GATCTAAGATGGCGACTGTCGAA | 758 | TTAGATTCCGTTTCTCCCTTCTG | 759 | ACCACCCCTACTCCTAATCCCCGACT | 760 | GATCTAAGATGGCGACTGTCGAACCGAAACCACCCCTACTCCTAATCCCCGACTACAGAAGAGGAGAAAA |
| EIF5 | NM_001969 | 761 | GAATTGGTCTCCA | 762 | TCCAGGTATATGGCT | 763 | CCACTTGCACCCGAATCTTTG | 764 | GAATTGGTCTCCACCTGCCTTTGATCAAGATTCGGGT |
| ELK4 | NM_001973 | 765 | GATGTGGAGAATG | 766 | AGTCATTGCGGCTAG | 767 | ATAAACCACCTCAGCCTGGT | 768 | GATGTGGAGAATGAGGGAAAGATAAACCACCTCAG |
| ENPP2 | NM_006209 | 769 | CTCCTGCCACTA | 770 | TCCCTGGATAATTGG | 771 | TAACTTCCTCTGGCATGGTT | 772 | CTCCTGCCACTAATACCTTCAGGCCAACCATGCCAG |
| ENY2 | NM_020189 | 773 | CCTCAAAGAGTTG | 774 | CCTCTTTACAGTGTGC | 775 | CTGATCCTTCCAGCCACATT | 776 | CCTCAAAGAGTTGCTGAGAGCTAAATTAATTGAATGT |
| EPHA2 | NM_004431 | 777 | CGCCTGTTCACCA | 778 | GTGGCGTGCCTCGAA | 779 | TGCGCCCGATGAGATCACCG | 780 | CGCCTGTTCACCAAGATTGACACCATTGGGCCGATG |
| EPHA3 | NM_005233 | 781 | CAGTAGCCTCAAG | 782 | TTCGTCCCATATCCAG | 783 | TATTCCAAATCCGACCCGA | 784 | CAGTAGCCTCAAGCCTGACTATATACGTATTCCAA |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| EPHB2 | NM_004442 | 785 CAACCAGGCAGCT | 786 GTAATGCTGTCCACG | 787 CACCTGATGCATGATGGACA | 788 CAACCAGGCAGCTCCATCGGCAGTGTCCATCATGCA |
| EPHB4 | NM_004444 | 789 TGAACGGGTATCCTCCTTA | 790 AGGTACCTCTCGGTCAGTGG | 791 CGTCCCATTTGAGCCTGTCAATGT | 792 TGAACGGGTATCCTCCTTAGCCACGGGCCCGTCCCATTTGAGCCTGTCAATGTCACCACTGACCGAGAGT |
| ERBB2 | NM_004448 | 793 CGGTGTGAGAAGT | 794 CCTCTCGCAAGTGCT | 795 CCAGACCATAGCACACTCGG | 796 CGGTGTGAGAAGTGCAGCAAGCCCTGTGCCGAGTG |
| ERBB3 | NM_001982 | 797 CGGTTATGTCATGCCAGATACAC | 798 GAACTGAGAGCCACTGAAGAAAGG | 799 CCTCAAAGGTACTCCCTCCTCCCGG | 800 CGGTTATGTCATGCCAGATACACCTCAAAGGTACTCCCTCCTCCCGGGAAGGCACCCTTTCTTCAGTGGGTC |
| ERBB4 | NM_005235 | 801 TGGCTCTTAATCAGTTTCGTTACCT | 802 CAAGGCATATCGATCCTCATAAAGT | 803 TGTCCCACGAATAATGCGTAAATTCCCAG | 804 TGGCTCTTAATCAGTTTCGTTACCTCTGGAGAATTTACGCATTATTCGTGGGACAAAACTTTATGAGGAT |
| ERCC1 | NM_001983 | 805 GTCCAGGTGGATG | 806 CGGCCAGGATACACA | 807 CAGCAGGCCCTCAAGGAGCT | 808 GTCCAGGTGGATGTGAAAGATCCCAGCAGGCCCTC |
| EREG | NM_001432 | 809 TGTTAGGGTAAAC | 810 TGGAGACAAGTCCTG | 811 TAAGCCATGGCTGACCTCTG | 812 TGTTAGGGTAAACGAAGGCATAATAAGCCATGGCTG |
| ERG | NM_004449 | 813 CCAACACTAGGCT | 814 CCTCCGCCAGGTCTTT | 815 AGCCATATGCCTTCTCATCT | 816 CCAACACTAGGCTCCCCACCAGCCATATGCCTTCTCA |
| ESR1 | NM_000125 | 817 CGTGGTGCCCCTC | 818 GGCTAGTGCCGCAT | 819 CTGGAGATGCTGGACGCCC | 820 CGTGGTGCCCCTCTATGACCTGCTGAGATGCTG |
| ESR2 | NM_001437 | 821 TGGTCCATCGCCAGTTATCA | 822 TGTTCTAGCGATCTTGCTTCACA | 823 ATCTGTATGCGGAACCTCAAAAGAGTCCCT | 824 TGGTCCATCGCCAGTTATCACATCTGTATGCGGAACCTCAAAAGAGTCCCTGGTGTGAAGCAAGATCGCTAGA |
| ETV1 | NM_004956 | 825 TCAAACAAGAGCC | 826 AACTGCCAGAGCTGA | 827 ATCGGGAAGGACCCCACATAC | 828 TCAAACAAGAGCCAGGAATGTATCGGGAAGGACCCCA |
| ETV4 | NM_001986 | 829 TCCAGTGCCTATG | 830 ACTGTCCAAGGGCAC | 831 CAGACAAATCGCCATCAAGT | 832 TCCAGTGCCTATGACCCCCCAGACAAATCGCCATCA |
| EZH2 | NM_004456 | 833 TGGAAACAGCGAAGGAGATACA | 834 CACCGAACACTCCCTAGTCC | 835 TCCTGACTTCTGTGAGCTCATTGCG | 836 TGGAAACAGCGAAGGAGATACAGCCTGTGCACATCCTGACTTCTGTGAGCTCATTGCGCGGGACTAGGGAGTGTT |
| F2R | NM_001992 | 837 AAGGAGCAAACCA | 838 GCAGGGTTTCATTGA | 839 CCCGGGCTCAACATCACTA | 840 AAGGAGCAAACCATCCAGTGCCCGGGCTCAACATCACATC |
| FAAH | NM_001441 | 841 GACAGCGTAGTGTGCATGT | 842 AGCTGAACATGGACTGTGGA | 843 TGCCCTTCGTGCACACCAATG | 844 GACAGCGTAGTGTGCATGTGCTGAAGCTGCAGACCAATGTAGGGGTGCCCGTGCCCTTCGTGCACACCAATGT |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| FABP5 | NM_001444 | 845 GCTGATGCGCAGAAAAACTCA | 846 CTTTCCTTCCCATCCCACT | 847 CCTGATGCTGAACCAATGCACCAT | 848 GCTGATGCGCAGAAAAACTCAGATCTGTCTGCAACTTTACAGATGGTGCATTGGTTCAGCATCAGGAGTGGGAT TCCACAGTCCA |
| FADD | NM_003824 | 849 GTTTTCGCGAGAT | 850 CTCCGGTGCCTGATTC | 851 AACGGCCTCTTGTCGATTTC | 852 GTTTTCGCGAGATAACGGTCTGATTCGAAAACGCGCTCTTGTC |
| FAM107 | NM_007177 | 853 AAGTCAGGGAAAA | 854 GCTGCCCTACAGCT | 855 AATTGCCACTGACCAGCG | 856 AAGTCAGGGAAAACCTGCGGAGAATTGCCACACTGA |
| FAM13C | NM_198215 | 857 ATCTTCAAAGCGG | 858 GCTGGATACCACATG | 859 TCCTGACTTCTCCGTGGCT | 860 ATCTTCAAAGCGGAGAGCGGGAGGAGCCACGGAGAA |
| FAM171B | NM_177454 | 861 CCAGGAAGGAAAAGCACTGT | 862 GTGGTCTGCCCCTTCTTTTA | 863 TGAAGATTTTGAAGCTAATACATCCCCCAC | 864 CCAGGAAGGAAAAGCACTGTGAAGATTTTGAAGCTAATACATCCCCCACTAAAAGAAGGGGCAGACCAC |
| FAM49B | NM_016623 | 865 AGATGCAGAAGGC | 866 GCTGGATTGCCTCT | 867 TGGCCAGTCCTCTCTGTATGA | 868 AGATGCAGAAGGCATCTTGGAGGACTTGCAGTCATA |
| FAM73A | NM_198549 | 869 TGAGAAGGTGCGCTATTCAA | 870 GGCCATTAAAAGCTTCAGTGC | 871 AAGACCTCATGCAGTTACTCATTCGCC | 872 TGAGAAGGTGCGCTATTCAAGTACAGACTTTAGCTGAAGACCTCATGCAGTTACTCATTCGCCCACTGAG |
| FAP | NM_004460 | 873 GTTGGCTCACGTG | 874 GACAGGACCGAAACA | 875 AGCCACTGCAAACATACTCG | 876 GTTGGCTCACGTGGGTTACTGATGAACAGATATGTTT |
| FAS | NM_000043 | 877 GGATTGCTCAACAACCATGCT | 878 GGCATTAACACTTTTGGACGATAA | 879 TCTGGACCCTCCTACCTCTGTTCTTACGT | 880 GGATTGCTCAACAACCATGCTGGCATCTGGACCCCTCCTACCTCTGTTCTTACGTCTGTTGCTAGATTATCG |
| FASLG | NM_000639 | 881 GCACTTTGGGATTCTTTCCATTAT | 882 GCATGTAAGAGACCCCTCACTGAA | 883 ACAACATTCTGGTGCCTGTAACAAGAA | 884 GCACTTTGGGATTCTTTCCATTATGATTCTTTGTTACAGCACCGAGAATGTTGTATTCAGTGAGGGTCTTCTT |
| FASN | NM_004104 | 885 GCCTCTTCCTGTTC | 886 GCTTTGCCCGGTAGC | 887 TCGCCCACTTACGTACTGGC | 888 GCCTCTTCCTGTTCGACGGCTCGCCCACCTACGTACT |
| FCGR3A | NM_000569 | 889 GTCTCCAGTGGAA | 890 AGGAATGCAGCTACT | 891 CCCATGATCTTCAAGCAGGG | 892 GTCTCCAGTGGAAGGGAAAAGCCCATGATCTTCAAG |
| FGF10 | NM_004465 | 893 TCTTCCGTCCCTGT | 894 AGAGTTGGTGGCCTC | 895 ACACCATGTCCTGACCAAGG | 896 TCTTCCGTCCCTGTCACCTGCCAAGCCCTTGGTCAGG |
| FGF17 | NM_003867 | 897 GGTGGCTGTCCTC | 898 TCTAGCCAGGAGGAG | 899 TTCTCGGATCCTCAGTC | 900 GGTGGCTGTCCTCAAAATCGCTTCTCGGATCTCCCT |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| FGF5 | NM_004464 | 901 GCATCGGTTTCCA | 902 AACATATTGGCTTCGT | 903 CCAATTGACTTTGCCA TCCGG | 904 GCATCGGTTTCCATCTGCAGATCTACCCGGA TGGCAA |
| FGF6 | NM_020996 | 905 GGGCCATTAATTCTGACCAC | 906 CCCGGACATAGTGATGAA | 907 CATCCACCTTGCCTC TCAGGCAC | 908 GGGCCATTAATTCTGACCACGTGCCTGAGAG GCAAGGTGGATGGCCCCTGGGACAGAAACTGT TCATCACTAT |
| FGF7 | NM_002009 | 909 CCAGAGCAAATGGCTACAAA | 910 TCCCCTCCTTCCATGTAATC | 911 CAGCCCTGAGCGACA CACAAGAAG | 912 CCAGAGCAAATGGCTACAAATGTGAACTGTT CCAGCCCTGAGCGACACACAAGAAGTTATGA TTACATGGAA |
| FGFR2 | NM_000141 | 913 GAGGGACTGTTGGCATGCA | 914 GAGTGAGAATTCGATCCAAGTCTT C | 915 TCCCAGAGACCAACG TTCAAGCAGTTG | 916 GAGGGACTGTTGGCATGCAGTGCCTCCCAG AGACCAACGTTCAAGCAGTTGGTAGAAGACT TGGATCGAAT |
| FGFR4 | NM_002011 | 917 CTGGCTTAAGGATGGACAGG | 918 ACGAGACTCCAGTGCTGATG | 919 CCTTTCATGGGGAGA ACCGCATT | 920 CTGGCTTAAGGATGGACAGGCCTTTCATGGG GAGAACCGCATTGAGGGCATTCGGCTGCCC ATCAGCACTG |
| FKBP5 | NM_004117 | 921 CCCAGTAGAGG | 922 GGTTCTGGCTTTCACG | 923 TCTCCCCAGTTCCAC AGCAG | 924 CCCACAGTAGAGGGGTCTCATGTCTCCCCAG TTCCAC |
| FLNA | NM_001456 | 925 GAACCTGCGGTGG | 926 GAAGACACCCTGGCC | 927 TACCAGGCCCATAGC ACTGG | 928 GAACCTGCGGTGGACACTTCCGGTGTCAGT GCTAT |
| FLNC | NM_001458 | 929 CAGGACAATGGTG | 930 TGATGGTGTACTCGC | 931 ATGTGCTGTCAGCTA CCTGC | 932 CAGGACAATGGTGATGGCTCATGTGCTGTCA GCTAC |
| FLT1 | NM_002019 | 933 GGCTCCTGAATCT | 934 TCCACCAGCAATACT | 935 CTACAGCACCAAGAG CGAC | 936 GGCTCCTGAATCTATCTTTGACAAAATCTAC AGCACC |
| FLT4 | NM_002020 | 937 ACCAAGAAGCTGA | 938 CCTGGAAGCTGTAGC | 939 AGCCCCCTGCTGACCATG GAAGA | 940 ACCAAGAAGCTGAGGACCTGTGGCTGAGCCC GCTGA |
| FN1 | NM_002026 | 941 GGAAGTGACAGAC | 942 ACACGGTAGCCGGTC | 943 ACTCTTCAGGCGGTGT CCACA | 944 GGAAGTGACAGACGTGAAGGTCACCACCATG TGGAC |
| FOS | NM_005252 | 945 CGAGCCCTTTGATGACTTCCT | 946 GGAGCGGGCTGTCTCAGA | 947 TCCCAGCATCATCCA GGCCCAG | 948 CGAGCCCTTTGATGACTTCCTGTTCCCAGCA TCATCCAGGCCCAGTGGCTCTGAGACAGCCC GCTCC |
| FOXO1 | NM_002015 | 949 GTAAGCACCATGC | 950 GGGGCAGAGGCACTT | 951 TATGAACGCCTGAC CCAAG | 952 GTAAGCACCATGCCCCACACCTCCGGGTATGA ACCGC |
| FOXP3 | NM_014009 | 953 CTGTTGCTGTCCG | 954 GTGAGGAACTCTGG | 955 TGTTTCCATGGCTAC CCCAC | 956 CTGTTGCTGTCCGGAGGCACCTGTGGGGTA GCCAT |
| FOXQ1 | NM_033260 | 957 TGTTTTGTCGCAA | 958 TGGAAAGGTCCCTG | 959 TGATTATGTCCCTT CCCTC | 960 TGTTTTGTCGCAACTTCCATTGATTATGT CCCTTCC |

TABLE A-continued

| Official Symbol: | Accession Number: | SEQ ID NO | Forward Primer Sequence: | SEQ ID NO | Reverse Primer Sequence: | SEQ ID NO | Probe Sequence: | SEQ ID NO | Amplicon Sequence: |
|---|---|---|---|---|---|---|---|---|---|
| FSD1 | NM_024333 | 961 | AGGCCTCCTGTCC | 962 | TGTGTGAACCTGGTC | 963 | CGCACCAAACAAGTGCTGCA | 964 | AGGCCTCCTGTCCTTCTACAATGCCGCACCAAACAA |
| FYN | NM_002037 | 965 | GAAGCGCAGAATCA | 966 | CTCCTCAGAGACACCAC | 967 | CTGAAGCACGACAAGCTGGT | 968 | GAAGCGCAGATCATGAAGAAGCTGAAGCACGACAAG |
| G6PD | NM_000402 | 969 | AATCTGCCTGTGG | 970 | CGAGATGTTGCTGGT | 971 | CCAGCCTCAGTGCCACTTGA | 972 | AATCTGCCTGTGGCCTTGCCCGCCAGCCTCAGTGCCA |
| GABRG2 | NM_198904 | 973 | CCACTGTCCTGACAATGACC | 974 | GAGATCCATCGCTGTGACAT | 975 | CTCAGCACCATTGCCGGAAAT | 976 | CCACTGTCCTGACAATGACCACCCTCAGCACCATTGCCCGGAAATCGCTCCCCAAGGTCTCCTATGTCACAGC |
| GADD45 | NM_001924 | 977 | GTGCTGGTGTGACGA | 978 | CCCCGGCAAAAACAAA | 979 | TTCATCTCAATGGAAGGATC | 980 | GTGCTGGTGACGAATCCATTCATCTCAATGGAAGG |
| GADD45 | NM_015675 | 981 | ACCCTCGACAAGA | 982 | TGGGAGTTCATGGGT | 983 | TGGGAGTTCATGGGTACAGA | 984 | ACCCTCGACAAGACCACACTTTGGGACTTGGGAGCT |
| GDF15 | NM_004864 | 985 | CGCTCCCAGACCTA | 986 | ACAGTGGAAGGACCA | 987 | TGTTAGCCAAAGACTGCCAC | 988 | CGCTCCCAGACCTATGATGACTTGTTAGCCAAAGACTG |
| GHR | NM_000163 | 989 | CCACCTCCCCACAG | 990 | GGTGCGTGCCTGTAG | 991 | CGTGCCTCAGCCTCCTGAGT | 992 | CCACCTCCCACAGTTCAGGCGGATTCCCGTGCCTCAG |
| GNPTAB | NM_024312 | 993 | GGATTCACATCGC | 994 | GTTCTTGCATAACAAT | 995 | CCCTGCTCACATGCCTCACA | 996 | GGATTCACATCGCCGGAAAGTCCCTGCTCACATGCCTC |
| GNRH1 | NM_000825 | 997 | AAGGGCTAAATCCAGGTGTG | 998 | CTGGATCTCTGTGGCTGGT | 999 | TCCTGTCCTTCACTGTCCTTGCCA | 1000 | AAGGCTAAATCCAGGTGTGACGGTATCTAATGATGTCCTTGTCCTTCACTGTCCTTGCCATCACCAGCCACAG |
| GPM6B | NM_001001994 | 1001 | ATGTGCTTGGAGTGGCCT | 1002 | TGTAGAACATAAACACGGGCA | 1003 | CGCTGAGAACCAAACACACCCAG | 1004 | ATGTGCTTGGAGTGGCCTGGTGTGTTTGGTTTCTCAGCGGTGCCCGTGTTTATGTTCTACA |
| GPNMB | NM_001005340 | 1005 | CAGCCTCGCCTTTAAGGAT | 1006 | TGACAAATATGGCCAAGCAG | 1007 | CAAACAGTGCCCTGATCTCCGTTG | 1008 | CAGCCTCGCCTTTAAGGATGGCAAACAGTGCCCTGATCTCCGTTGGCCTGCTTGGCCATATTTGTCA |
| GPR68 | NM_003485 | 1009 | CAAGGACCAGATC | 1010 | GGTAGGGCAGGAAGC | 1011 | CTCAGCACCGTGGTCATCTT | 1012 | CAAGGACCAGATCCAGCGACCGTGGTCTGCTCAGCACCGT |
| GPS1 | NM_004127 | 1013 | AGTACAAGCAGGC | 1014 | GCAGCTCAGGGAAGT | 1015 | CCTCCTGCTGGCTTCCTTTG | 1016 | AGTACAAGCAGGCTGCCAAGTGCCTCCTGCTTGGCTT |
| GRB7 | NM_005310 | 1017 | CCATCTGCATCCA | 1018 | GGCACCAGGGTATT | 1019 | CTCCCCACCCTTGAGAAGTG | 1020 | CCATCTGCATCCATCTTGTTTGGGCTCCCACCCTTG |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| GREM1 | NM_013372 | 1021 GTGTGGGCAAGGA | 1022 GACCTGATTGGCCT | 1023 TCCACCCTCCCTTTC TCACT | 1024 GTGTGGGCAAGGACAAGCAGGATAGTGGAGT GAGAA |
| GSK3B | NM_002093 | 1025 GACAAGGACGGCA | 1026 TTGTGGCCTGTCTGG | 1027 CCAGGAGTTGCCACC ACTGT | 1028 GACAAGGACGGCAGCAGGCAAGTGACAACAGTGG TGGCA |
| GSN | NM_000177 | 1029 CTTCTGCTAAGCGGTACATCGA | 1030 GGCTCAAAGCCTTGCTTCAC | 1031 ACCCAGCCAATCGGG ATCGGC | 1032 CTTCTGCTAAGCGGTACATCGAGACGGACCC AGCCAATCGGGATCGGCGACGCCCATCACC GTGTGAAGC |
| GSTM1 | NM_000561 | 1033 AAGCTATGAGGAAAAGAAGTACAC GA | 1034 GGCCCAGCTTGAATTTTTCA | 1035 TCAGCCACTGCTTC TGTCATAATCAGGAG | 1036 AAGCTATGAGGAAAAGAAGTACACGATGGG GACGCTCCTGATTATGACAGAAGCCAGTGGC TGAATGAAAA |
| GSTM2 | NM_000848 | 1037 CTGCAGGCACTCC | 1038 CCAAGAAACCATGGC | 1039 CTGAAGCTCTACTCA CAGTT | 1040 CTGCAGGCACTCCCTGAAATGCTGAAGCTCT ACTCAC |
| HDAC1 | NM_004964 | 1041 CAAGTACCACAGCGATGACTACAT TA | 1042 GCTTGCTGTACTCCGACATGTT | 1043 TTCTTGCGCTCCATC CGTCCAGA | 1044 CAAGTACCACAGCGATGACTACATTAAATTC TTGCGCTCCATCCGTCCAGATAACATGTCGG AGTACAGCAAG |
| HDAC9 | NM_178423 | 1045 AACCAGGCAGTCACCTTGAG | 1046 CTCTGTCTTCCTGCATGC | 1047 CCCCCTGAAGCTCTT CCTCTGCTT | 1048 AACCAGGCAGTCACCTTGAGGAAGCAGAAGA AGAGCTTCAGGGGACCAGGCGATGCAGGAA GACAGAG |
| HGD | NM_000187 | 1049 CTCAGGTCTGCCC | 1050 TTATTGGTGCTCCGTG | 1051 CTGAGCAGCTCTCAG GATCG | 1052 CTCAGGTCTGCCCTACAATCTCTATGCTGA GCAGCT |
| HIP1 | NM_005338 | 1053 CTCAGAGCCCCAC | 1054 GGGGTTTCCCTGCCAT | 1055 CGACTCACTGACCGA GGCCT | 1056 CTCAGAGCCCCACCTGAGCCTGCCGACTCAC TGACC |
| HIRIP3 | NM_003609 | 1057 GGATGAGGAAAAG | 1058 TCCCTAGCTGACTTTC | 1059 CCATTGCTCCTGGTT CTGGG | 1060 GGATGAGGAAAAGGGGATTGGAAACCCAGA ACCAG |
| HK1 | NM_000188 | 1061 TACGCACAGAGG | 1062 GAGAGAGTGCTGGA | 1063 TAAGAGTCCGGATC CCCAG | 1064 TACGCACAGAGGCAAGCAGCTAGAGTCCGG GATCC |
| HLA-G | NM_002127 | 1065 CCATCCCCATCAT | 1066 CCGCAGCTCCAGTGA | 1067 CTGCAAGGACAACCA GGCC | 1068 CCTGCGCGGCTACTACAACCAGAGCGAGGCC AGTTC |
| HLF | NM_002126 | 1069 CACCCTGCAGGTG | 1070 GGTACCTAGGAGCAG | 1071 TAAGTGATCTGCCCT CCAGG | 1072 CACCCTGCAGGTGTCTGAGACTAAGTGATCT GCCCTC |
| HNF1B | NM_000458 | 1073 TCCCAGCATCTCA | 1074 CGTACCAGGTGTACA | 1075 CCCCTATGAAGACCC AGAAG | 1076 TCCCAGCATCTCAACAAGGCCACCCTATGA AGACC |
| HPS1 | NM_000195 | 1077 GCGGAAGCTGTAT | 1078 TTCGGATAAGATGAC | 1079 CAGTCACCAGCCCAA AGTGC | 1080 GCGGAAGCTGTATGTGCTCAAGTACCTGTTT GAAGT |

TABLE A-continued

| Official Symbol: | Accession Number: | SEQ ID NO | Forward Primer Sequence: | SEQ ID NO | Reverse Primer Sequence: | SEQ ID NO | Probe Sequence: | SEQ ID NO | Amplicon Sequence: |
|---|---|---|---|---|---|---|---|---|---|
| HRAS | NM_005343 | 1081 | GGACGAATACGAC | 1082 | GCACGTCTCCCCATC | 1083 | ACCACTGCTTCCGG TAGGA | 1084 | GGACGAATACGACCCCACTATAGAGGATTCC TACCG |
| HSD17B10 | NM_004493 | 1085 | CCAGCGAGTTCTTGATGTGA | 1086 | ATCTCACCAGCCACCAGG | 1087 | TCATGGCACCTTCA ATGTGATCC | 1088 | CCACCAGACAAGACCGATTCGCTGCCTCCA TTTCTTCAACCCAGTGCCTGTCATGAAACTT GTGG |
| HSD17B2 | NM_002153 | 1089 | GCTTTCCAAGTGG | 1090 | TGCCTGCGATATTTGT | 1091 | AGTTGCTTCCATCA ACCTG | 1092 | GCTTTCCAAGTGGGGAATTAAAGTTGCTTCC ATCCAA |
| HSD17B3 | NM_000197 | 1093 | GGGACGTCCTGGAACAGT | 1094 | TGGAGAATCTCACGCACTTC | 1095 | CTTCATCCTCACAGG GCTGCTGGT | 1096 | GGGACGTCCTGGAACAGTTCTTCATCCTCAC AGGGCTGCTGGTGTGCCTCGCCTGCCTGGCG AAGTGCGTGAG |
| HSD17B4 | NM_000414 | 1097 | CGGGAAGCTTCAG | 1098 | ACCTCAGGGCCCAATA | 1099 | AGGGCGGCGTCCTATT TCCTC | 1100 | CGGGAAGCTTCAGAGTACCTTTGTATTTGAG GAAAT |
| HSD3B2 | NM_000198 | 1101 | GCCTTCCTTTAACC | 1102 | GGAGTAAATTGGGCT | 1103 | ACTTCCAGCAGGAAG CCAAT | 1104 | GCCTTCCTTTAACCTGATGTACTGGATTGG CTTCCT |
| HSP90AB1 | NM_007355 | 1105 | GCATTGTGACCAGCACCTA | 1106 | GAAGTGCCTGGGCTTTCAT | 1107 | ATCCGCTTCATATTG GCTGTCCAG | 1108 | GCATTGTGACCAGCACCTACGGCTGGACAGC CAATATGAGCGGATCATGAAAGCCCAGGCA CTTC |
| HSPA5 | NM_005347 | 1109 | GGCTAGTAGAACTGGATCCCAACA | 1110 | GGTCTGCCCAAATGCTTTTC | 1111 | TAATTAGACCTAGGC CTCAGCTGCACTGCC | 1112 | GGCTAGTAGAACTGGATCCCAACACCAAAAC TCTTAATTAGACCTAGGCCTCAGCTGCACTG CCCGAAAAGCA |
| HSPA8 | NM_006597 | 1113 | CCTCCCCTCTGGTGTGCTT | 1114 | GCTACATCTACACTTGGTTGGCTT AA | 1115 | CTCAGGGCCCACCAT TGAAGAGGTTG | 1116 | CCTCCCCTCTGGTGTGCTTCCTCAGGGCCCA CCATTGAAGAGGTTGATTAAGCCAACCAAGT GTAGATGTAGC |
| HSPB1 | NM_001540 | 1117 | CCGACTGAGGAGCATAAA | 1118 | ATGCTGGCTGACTCTGCTC | 1119 | CGCACTTTTCTGAGC AGACGTCCA | 1120 | CCGACTGAGGAGCATAAAAGCCAGCCAG CCCAGCGCCCCGCACTTTTCTGAGCAGACGT CCAGAGCAGA |
| HSPB2 | NM_001541 | 1121 | CACCACTCCAGAG | 1122 | TGGGACCAAACCATA | 1123 | CACCTTTCCCTTCCC CCAAG | 1124 | CACCACTCCAGAGTAGCAGCATCCTTGGG GAAGG |
| HSPE1 | NM_002157 | 1125 | GCAAGCAACAGTAGTCGCTG | 1126 | CCAACTTTCACGCTAACTGGT | 1127 | TCTCCACCCTTTCCT TTAGAACCCG | 1128 | GCAAGCAACAGTAGTCGCTTGCTTGGATCGGGT TCTAAAGGAAAGGGTGGAGAGATTCAACCAG TTAGCGTGAA |
| HSPG2 | NM_005529 | 1129 | GAGTACGTGTGCC | 1130 | CTCAATGGTGACCAG | 1131 | CAGCTCCGTGCCTCT AGAGG | 1132 | GAGTACGTGTGCCCAGTGTTGGGCAGCTCCG TGCCT |
| ICAM1 | NM_000201 | 1133 | GCAGACAGTGACCATCTACAGCTT | 1134 | CTTCTGAGACCTCTGGCTTCGT | 1135 | CCGGCGCCCAACGTG ATTCT | 1136 | GCAGACAGTGACCATCTACAGCTTTCCGCCG CCCAACGTGATTCTGACGAAGCCAGAGGTCT CAGAAG |

TABLE A-continued

| Official Symbol: | Accession Number: | SEQ ID NO Forward Primer: | Forward Primer Sequence: | SEQ ID NO Reverse Primer: | Reverse Primer Sequence: | SEQ ID NO Probe: | Probe Sequence: | SEQ ID NO Amplicon: | Amplicon Sequence: |
|---|---|---|---|---|---|---|---|---|---|
| IER3 | NM_003897 | 1137 | GTACCTGTGTGCGCGAGAG | 1138 | GCGTCTCCGCTGTAGTGTT | 1139 | TCAAGTTGCTTCCGAAGTCCCAGT | 1140 | GTACCTGTGTGCGCGAGAGCGTATCCCAACTGGGACTTCCGAGGCAACTTGAACTCAGAACACTACAGCGGA |
| IFI30 | NM_006332 | 1141 | ATCCCATGAAGCC | 1142 | GCACCATTCTTAGTG | 1143 | AAAATTCCACCCCATGATCA | 1144 | ATCCCATGAAGCCCAGATACACAAATTCCACCCCA |
| IFIT1 | NM_001548 | 1145 | TGACAACCAAGCA | 1146 | CAGTCTGCCCATGTG | 1147 | AAGTTGCCCCAGGTCACCAG | 1148 | TGACAACCAAGCAAATGTGAGGAGTCTGTGACCTG |
| IFNG | NM_000619 | 1149 | GCTAAAACAGGGGAAGCGAAA | 1150 | CAACCATTACTGGGATGCTC | 1151 | TCGACCTCGAAACAGCATCTGACTCC | 1152 | GCTAAAACAGGGGAAGCGAAAAGAGAGTCAGATGCTTTTCGAGGTCGAAGAGCATCCCAGTAATGGTTG |
| IGF1 | NM_000618 | 1153 | TCCGGAGCTGTGA | 1154 | CGGACAGAGCGAGCT | 1155 | TGTATTGCGCACCCCTCAAG | 1156 | TCCGGAGCTGTGATCTAAGGAGGCTGGAGATGTATT |
| IGF1R | NM_000875 | 1157 | GCATGGTAGCCGAAGATTTCA | 1158 | TTTCCGGTAATAGTCTGTCTCATAGATATC | 1159 | CCGGTCATACCAAAATCTCCGATTTTGA | 1160 | GCATGGTAGCCGAAGATTTCACAGTCAAAATCGGAGATTTTGGTATGACCGAGATATCTATGAGACAGACTA |
| IGF2 | NM_000612 | 1161 | CCGTGCTTCCGGAA | 1162 | TGGACTGCTTCCAGG | 1163 | TACCCCGTGGGCAAGTTCTT | 1164 | CCGTGCTTCCGGACAACTTCCCAGATACCCCGTGGG |
| IGFBP2 | NM_000597 | 1165 | GTGGACAGCACCA | 1166 | CCTTCATACCCGACTT | 1167 | CTTCCGGCCAGACTTGCCTC | 1168 | GTGGACAGCACCATGAACATGTTGGGCGGGGAGGC |
| IGFBP3 | NM_000598 | 1169 | ACATCCCAACGCA | 1170 | CCACGCCCTTGTTTCA | 1171 | ACACCACAGAAGGCTGTGA | 1172 | ACATCCCAACGCATGTCCTGGAGCTCACAGCCTTCT |
| IGFBP5 | NM_000599 | 1173 | TGGACAAGTACGG | 1174 | CGAAGGTGTGGCACT | 1175 | CCCGTCAACTACTCCATGC | 1176 | TGGACAAGTACGGGATGAAGCTGCCAGGCATGGAGT |
| IGFBP6 | NM_002178 | 1177 | TGAACCGCAGAGACCAACAG | 1178 | GTCTTGGACACCCGCAGAAT | 1179 | ATCCAGGCACCTCTACCACGCCCTC | 1180 | TGAACCGCAGAGACCAACAGAGGAATCCAGGCACCTCTACCACGCCCTCCCAGCCCAATTCTGCGGGTGTCCA |
| IL10 | NM_000572 | 1181 | CTGACCACGCTTT | 1182 | CCAAGCCCAGAGACA | 1183 | TTGAGCTGTTTTCCCTGACC | 1184 | CTGACCACGCTTTCTAGCTGTTGAGCTGTTTCCCTG |
| IL11 | NM_000641 | 1185 | TGGAAGGTTCCAC | 1186 | TCTTTGACCTTGCAGCT | 1187 | CCTGTGATCAACAGTACCCG | 1188 | TGGAAGGTTCCACAAGTCACCCTGTGATCAACAGTA |
| IL17A | NM_002190 | 1189 | TCAAGCACACTC | 1190 | CAGCTCCTTTCTGGGT | 1191 | TGGCTTCTGTCTGATCAAGG | 1192 | TCAAGCACACTCCTTAGGGCCTGGCTTCTGTCTGATC |
| IL1A | NM_000575 | 1193 | GGTCCTTGGTAGA | 1194 | GGATGGAGCTTCAGG | 1195 | TCTCCACCCTGGCCCTGTTA | 1196 | GGTCCTTGGTAGAGGGCTACTTTACTGTAACAGGGC |

TABLE A-continued

| Official Symbol: | Accession Number: | SEQ ID NO | Forward Primer Sequence: | SEQ ID NO | Reverse Primer Sequence: | SEQ ID NO | Probe Sequence: | SEQ ID NO | Amplicon Sequence: |
|---|---|---|---|---|---|---|---|---|---|
| IL1B | NM_000576 | 1197 | AGCTGAGGAAGAT | 1198 | GGAAAGAAGGTGCTC | 1199 | TGCCCACAGACCTTC CAGGA | 1200 | AGCTGAGGAAGATGCTGGTTCCCTGCCCACA GACCT |
| IL2 | NM_000586 | 1201 | ACCTCAACTCCTGCCACAAT | 1202 | CACTGTTTGTGACAAGTGCAAG | 1203 | TGCAACTCCTGTCTT GCATTGCAC | 1204 | ACCTCAACTCCTGCCACAATGTACAGGATGC AACTCCTGTCTTGCATTGCACTAAGTCTTGC ACTTGTCACAAA |
| IL6 | NM_000600 | 1205 | CCTGAACCTTCCA | 1206 | ACCAGGCAAGTCTCC | 1207 | CCAGATTGGAAGCAT CCATC | 1208 | CCTGAACCTTCCAAAGATGGCTGAAAAAGAT GGATG |
| IL6R | NM_000565 | 1209 | CCAGCTTATCTCA | 1210 | CTGGCGTAGAACCTT | 1211 | CCTTTGGCTTCACGG AAGAG | 1212 | CCAGCTTATCTCAGGGGTGCGCCTTTGG CTTCAC |
| IL6ST | NM_002184 | 1213 | GGCCTAATGTTCC | 1214 | AAAATTGTGCCTTGG | 1215 | CATATTGCCCAGTGG TCACC | 1216 | GGCCTAATGTTCCAGATCCTTCAAAGAGTCA TATTGC |
| IL8 | NM_000584 | 1217 | AAGGAACCATCTCACTGTGTAA AC | 1218 | ATCAGGAAGGCTGCCAAGAG | 1219 | TGACTTCCAAGCTGG CCGTGGC | 1220 | AAGGAACCATCTCACTGTGTAAACATGAC TTCCAAGCTGGCCGTGGCTCTCTTGGCAGCC TTCCTGAT |
| ILF3 | NM_004516 | 1221 | GACACGCCAAGTG | 1222 | CTCAAGACCCGGATC | 1223 | ACACAAGACTTCAGC CCGTT | 1224 | GACACGCCAAGTGGTTCCAGGCCAGAGCCAA CGGGC |
| ILK | NM_001014794 | 1225 | CTCAGGATTTTCTCTGCATCC | 1226 | AGGAGCAGGTGGAGACTGG | 1227 | ATGTGCTCCCAGTGC TAGGTCCT | 1228 | CTCAGGATTTTCTCCATCCAAATGTGCTCC CAGTGCTAGGTCCTGCCTCCCAGTCTCCACCTGC TCCT |
| IMMT | NM_006839 | 1229 | CTGCCTATGCCAG | 1230 | GCTTTTCTCGGCTTCCT | 1231 | CAACTGCATGCTCT GAACA | 1232 | CTGCCTATGCCAGACTCCAGGAGGATCGAACA GGCTG |
| ING5 | NM_032329 | 1233 | CCTACAGCAAGTG | 1234 | CATCTCGTAGGTCTG | 1235 | CCAGTGCACTTTGT CGTCA | 1236 | CCTACAGCAAGTGCAAGGAATACAGTGACGA CAAAG |
| INHBA | NM_002192 | 1237 | GTGCCCGAGCCAT | 1238 | CGGTAGTAGTGGTTGATG | 1239 | ACGTCCGGGTCCTCA CTGTC | 1240 | GTGCCCGAGCCATATAGCACGTCCGGG TCCTC |
| INSL4 | NM_002195 | 1241 | CTGTCATATTGCCC | 1242 | CAGATTCCAGCAGCC | 1243 | TGAGAGACATTCAC CACCA | 1244 | CTGTCATATTGCCCCATGCCTGAGAAGACAT TCACCA |
| ITGA1 | NM_181501 | 1245 | GCTTCTCTCTGGAG | 1246 | CCTGTAGATAATGAC | 1247 | TTGCTGGACAGCCTC GGTAC | 1248 | GCTTCTCTCTGGAGATGTCTCTATATTGCTG GACAGC |
| ITGA3 | NM_002204 | 1249 | CCATGATCCTCAC | 1250 | GAAGCTTTGTAGCCG | 1251 | CACTCCAGACCTGC TTAGC | 1252 | CCATGATCCTCACTCTGTGGTGGACTATAC ACTCCA |
| ITGA4 | NM_000885 | 1253 | CAACGCTTCAGTG | 1254 | GTCTGGCCGGGATTC | 1255 | CGATCCTGCATCTGT AAATC | 1256 | CAACGCTTCAGTGATCAATCCCGGGCGATT TACAG |
| ITGA5 | NM_002205 | 1257 | AGGCCAGCCCTAC | 1258 | GTCTTCTCCACAGTCC | 1259 | TCTGAGCCTTGTCCT CTATC | 1260 | AGGCCAGCCCTACATATTCAGAGAAGCC GGATA |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| ITGA6 | NM_000210 | 1261 CAGTGACAAACAG | 1262 GTTTAGCCTCATGGG | 1263 TCGCCATCTTTGTGGGATT | 1264 CAGTGACAAACAGCCCTTCCAACCCAAGAATCCCA |
| ITGA7 | NM_002206 | 1265 GATATGATTGGTCGCTGCTTTG | 1266 AGAACTTCCATTCCCCACCAT | 1267 CAGCCAGGACCTGGCCATCCG | 1268 GATATGATTGGTCGCTGCTTTGTGTCTCAGCCAGACCTGGCCATCCGGGATGAGTTGGATGGTGGGAATGGA |
| ITGAD | NM_005353 | 1269 GAGCCTGGTGGAT | 1270 ACTGTCAGGATGCCC | 1271 CAACTGAAAGGCCTGACGTT | 1272 GAGCCTGGTGGATCCCATCGTCCAACTGAAAGGCCT |
| ITGB3 | NM_000212 | 1273 ACCGGGAGCCCTACATGAC | 1274 CCTTAAGCTCTTTCACTGACTCAATCT | 1275 AAATACCTGACAACCGTTACTGCCGTGAC | 1276 ACCGGGAGCCCTACATGACGAAAATACCTGCAACCGTTACTGCCGTGACGAGATTGAGTCAGTGAAAGAGC |
| ITGB4 | NM_000213 | 1277 CAAGGTGCCCTCA | 1278 GCGCACACCTTCATC | 1279 CACCAACCTGTACCCGTATT | 1280 CAAGGTGCCCTCAGTGAGCTCACCAACCTGTACCC |
| ITGB5 | NM_002213 | 1281 TCGTGAAAGATGA | 1282 GGTGAACATCATGAC | 1283 TGCTATGTTTCTACAAAACC | 1284 TCGTGAAAGATGACCAGGAGGCTGTGCTATGTTTCTA |
| ITPR1 | NM_002222 | 1285 GAGGAGTGTGTGG | 1286 GTAATCCCATGTCCG | 1287 CCATCCTAACGGAACGAGCT | 1288 GAGGAGGTGTGGGTGTTCCGCTTCCATCCTAACGGA |
| ITPR3 | NM_002224 | 1289 TTGCCATCGTGTC | 1290 ATGGAGCTGCGTCA | 1291 TCCAGGTCTCCGATCTCAGA | 1292 TTGCCATCGTGTCAGTGCCCGTGTCTGAGATCCGAGA |
| ITSN1 | NM_003024 | 1293 TAACTGGGATGCA | 1294 CTCTGCCTTAACTGGC | 1295 AGCCCTCTCTCACCGTTCCA | 1296 TAACTGGGATGCATGGGCAGCCCAGCCCTCTCTCAC |
| JAG1 | NM_000214 | 1297 TGGCTTACACTGG | 1298 GCATAGCTGTGAGAT | 1299 ACTCGATTTCCCAGCCAACC | 1300 TGGCTTACACTGGCAATGTAGTTTCTGTGGTTGGCT |
| JUN | NM_002228 | 1301 GACTGCAAAGATGGAAACGA | 1302 TAGCCATAAGGTCCGCTCTC | 1303 CTATGACGATGCCCTCAACGCCTC | 1304 GACTGCAAAGATGGAAACCACTTCTATGACGATGCCCTCAACGCCTCTTCCTCCGTCCGAGAGCGGACCT |
| JUNB | NM_002229 | 1305 CTGTCAGCTGCTG | 1306 AGGGGGTGTCCGTAA | 1307 CAAGGGACACGCCTTCTGAA | 1308 CTGTCAGCTGCTGTGGGCTTGGGGTCAAGGGACACGCCTT |
| KCNN2 | NM_021614 | 1309 TGTGCTATTCATCC | 1310 GGGCATAGGAGAAGG | 1311 TTATACATTCACATGGACGG | 1312 TGTGCTATTCATCCCATACTGGGAATTATACATTCA |
| KCTD12 | NM_138444 | 1313 AGCAGTACTGGCAG | 1314 TGGAGACCTGAGCAG | 1315 ACTCTTAGGCGGCAGCGTCC | 1316 AGCAGTTACTGGCAAGAGGGAGAAAGGACGCTGCCG |
| KHDRBS | NM_006558 | 1317 CGGGCAAGAAGAG | 1318 CTGTAGACGCCCTTT | 1319 CAAGACACAAGGCACCTTCA | 1320 CGGGCAAGAAGAGTGGACTAACTCAAGACACAAGGC |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| KIAA019 | NM_014846 | 1321 CAGACACCAGCTC | 1322 AACATTGTGAGGCGG | 1323 TCCCCAGTGTCCAGGCACAG | 1324 CAGACACCAGCTCTGAGGCCAGTTAATCATCCCCAG |
| KIAA024 | NM_014734 | 1325 CCGTGGGACATGG | 1326 GAAGCAAGTCCGTCT | 1327 TCCGCTAGTGATCCTTTGCA | 1328 CCGTGGGACATGGAGTGTTCCTTCCGCTAGTGATCCT |
| KIF4A | NM_012310 | 1329 AGAGCTGGTCTCC | 1330 GCTGGTCTTGCTCTGT | 1331 CAGGTCAGCAAACTTGAAAG | 1332 AGAGCTGGTCTCCTTCCAAAATACAGGTCAGCAAACT |
| KIT | NM_000222 | 1333 GAGGCAACTGCTTATGGCTTAATTA | 1334 GGCACTCGGCTTGAGCAT | 1335 TTACAGCGACAGTCATGGCCCAT | 1336 GAGGCAACTGCTTATGGCTTAATTAAGTCAGATGCGGGCCATGACTGTCGCTGTAAAGATGCTCAAGCCGAGT |
| KLC1 | NM_182923 | 1337 AGTGGCTACGGGA | 1338 TGAGCCACAGACTGC | 1339 CAACACGCAGCAGAAACTG | 1340 AGTGGCTACGGGATGAACTGGCCAACACGCAGCAGA |
| KLF6 | NM_001300 | 1341 CACCGAGACCGGCT | 1342 GCTCTAGGCAGGTCT | 1343 AGTACTCCTCCAGAGACGGC | 1344 CACCGAGACCGGCTACTTCTCGGCCGCTGCCGTCTCTGG |
| KLK1 | NM_002257 | 1345 AACACAGCCCAGTTGTTCA | 1346 CCAGGAGGCTCATGTTGAAG | 1347 TCAGTGAGAGCTTCCCACACCCTG | 1348 AACACAGCCCAGTTTGTTCATGTCAGTGAGAGCTTCCCACACCCTGGCTTCAACATGAGCCTCCTGG |
| KLK10 | NM_002776 | 1349 GCCCAGAGGCTCC | 1350 CAGAGGTTTGAACAG | 1351 CCTCTTCCTCCCCAGTCGGC | 1352 GCCCAGAGGCTCCATCCATCCCATCCTCCTTCCTCCCCCAG |
| KLK11 | NM_006853 | 1353 CACCCCGGCTTCA | 1354 CATCTTCACCAGCAT | 1355 CCTCCCCAACAAAGACCACC | 1356 CACCCCGGCTTCAACAACAGCCTCCCCAACAAAGAC |
| KLK14 | NM_022046 | 1357 CCCCTAAAATGTT | 1358 CTCATCCTCTTGGCTC | 1359 CAGCACTTCAAGTCCTGGCT | 1360 CCCCTAAAATGTTCCTCCTGCTGACAGCACTTCAAGT |
| KLK2 | NM_005551 | 1361 AGTCTCGGATTGT | 1362 TGTACACAGCCACCT | 1363 TTGGGAATGCTTCTCACACT | 1364 AGTCTCGGATTGTGGGAGGCTGGGAGTGTGAGAAGC |
| KLK3 | NM_001648 | 1365 CCAAGCTTACCAC | 1366 AGGGTGAGGAAGACA | 1367 ACCCACATGGTGACACAGCT | 1368 CCAAGCTTACCACCTGCACCCGGAGAGCTGTGTCAC |
| KLRK1 | NM_007360 | 1369 TGAGAGCCAGGCT | 1370 ATCCTGGTCCTCTTTG | 1371 TGTCTCAAAATGCCAGCCTT | 1372 TGAGAGCCAGGCTTCTTTGTATGTCTCAAAATGCCAGC |
| KPNA2 | NM_002266 | 1373 TGATGGTCCAAAT | 1374 AAGCTTCACAAGTTG | 1375 ACTCCTGTTTTCACCACCAT | 1376 TGATGGTCCAAATGAACGAATTGGCATGGTGGTGAA |
| KRT1 | NM_006121 | 1377 TGGACAACAACCG | 1378 TATCCTCGTACTGGG | 1379 CCTCAGCAATGATGCTGTCC | 1380 TGGACAACAACCGAGTCTCGACCTGGACAGCATCA |
| KRT15 | NM_002275 | 1381 GCCTGGTTCTTCA | 1382 CTTGCTGGTCTGGATC | 1383 TGAACAAAGAGGTGGCCTCC | 1384 GCCTGGTTCTTCAGCAAGACTGAGGAGCTGAACAAA |

TABLE A-continued

| Official Symbol: | Accession Number: | SEQ ID NO | Forward Primer Sequence: | SEQ ID NO | Reverse Primer Sequence: | SEQ ID NO | Probe Sequence: | SEQ ID NO | Amplicon Sequence: |
|---|---|---|---|---|---|---|---|---|---|
| KRT18 | NM_000224 | 1385 | AGAGATCGAGGCT | 1386 | GGCCTTTTACTTCCTC | 1387 | TGGTTCTTCTTCATGAAGAG | 1388 | AGAGATCGAGGCTCTCAAGGAGGAGCTGCTCTTCAT |
| KRT2 | NM_000423 | 1389 | CCAGTGACGCCTC | 1390 | GGGCATGGCTAGAAG | 1391 | ACCTAGACAGCACAGATTCC | 1392 | CCAGTGACGCCTCTGTGTTCTCGGGGCGAATCTGTGC |
| KRT5 | NM_000424 | 1393 | TCAGTGGAGAAGG | 1394 | TGCCATATCCAGAGG | 1395 | CCAGTCAACATCTCTGTTGT | 1396 | TCAGTGGAGAAGGAGTTGGACCAGTCAACATCTCTG |
| KRT75 | NM_004693 | 1397 | TCAAAGTCAGGTACGAAGATGAAATT | 1398 | ACGTCCTTTTTCAGGGCTACAA | 1399 | TCATTCTCCAGCTGTGCCTTGT | 1400 | TCAAAGTCAGGTACGAAGATGAAATTACAAGGGCACAGCTGCTGAGAATGAATTTGTAGCCCTGAAAAAGG |
| KRT76 | NM_015848 | 1401 | ATCTCCAGACTGCTGGTTCC | 1402 | TCAGGGAATTAGGGGACAGA | 1403 | TCTGGGCTTCAGATCCTGACTCCC | 1404 | ATCTCCAGACTGCTGGTTCCCAGGGAACCCTCCCTACATCTGGGCTTCAGATCCTGACTCCCTTCTGTCCCCTA |
| KRT8 | NM_002273 | 1405 | GGATGAAGCTTACATGAACAAGGTAG | 1406 | CATATAGCTGCCTGAGGAAGTTGAT | 1407 | CGTCGGTCAGCCCCTTCCAGGC | 1408 | GGATGAAGCTTACATGAACAAGGTAGACTGGAGTCTCGCCTGAAGGGCTTGACCGACGAGATCAACTTCCT |
| L1CAM | NM_000425 | 1409 | CTTGCTGCCAAT | 1410 | TGATTGTCCGCAGTC | 1411 | ATCTACGTTGTCCAGCTGCC | 1412 | CTTGCTGCCAATGCCTACATCTACGTTGTCCAGCTG |
| LAG3 | NM_002286 | 1413 | GCCTTAGAGCAAG | 1414 | CGGTTCTTGCTCCAGC | 1415 | TCTATCTTGCTCTGAGCCTG | 1416 | GCCTTAGAGCAAGGGATTCACCCTCCGCAGGCTCAG |
| LAMA3 | NM_000227 | 1417 | CCTGTCACTGAAG | 1418 | TGGGTTACTGGTCAG | 1419 | ATTCAGACTGACAGGCCCCT | 1420 | CCTGTCACTGAAGCCTTGAAGTCCAGGGGCCTGTC |
| LAMA4 | NM_002290 | 1421 | GATGCACTGCGGT | 1422 | CAGAGGATACGCTCA | 1423 | CTCTCCATCGAGGAAGGCAA | 1424 | GATGCACTGCGGTTAGCAGCCGCTCTCCATCGAGGAA |
| LAMA5 | NM_005560 | 1425 | CTCCTGGCCAACA | 1426 | ACACAAGGCCCAGCC | 1427 | CTGTTCCTGGAGCATGGCCT | 1428 | CTCCTGGCCAACAGCACTGCACTAGAAGAGGCCATG |
| LAMB1 | NM_002291 | 1429 | CAAGGAGACTGGG | 1430 | CGGCAGAACTGACAG | 1431 | CAAGTGCCTGTACCACACGG | 1432 | CAAGGAGACTGGGAGGTGTCTCAAGTGCCTGTACCA |
| LAMB3 | NM_000228 | 1433 | ACTGACCAAGCCT | 1434 | GTCACACTTGCAGCA | 1435 | CCACTCGCCATACTGGGTGC | 1436 | ACTGACCAAGCCTGAGACCTACTGCACCCAGTATGG |
| LAMC1 | NM_002293 | 1437 | GCCGTGATCTCAG | 1438 | ACCTGCTTGCCCAAG | 1439 | CCTCGGTACTTCATTGCTCC | 1440 | GCCGTGATCTCAGACAGCAGTTTCCTCGTACTTCA |
| LAMC2 | NM_005562 | 1441 | ACTCAAGCGGAAATTGAAGCA | 1442 | ACTCCCTGAAGCCGAGACACT | 1443 | AGGTCTTATCAGCACAGTCTCCGCCTCC | 1444 | ACTCAAGCGGAAATTGAAGCAGATAGTCTTATCAGCACAGTCTCCGCCTCCCTGATTCAGTGTCTCGGCTTC |

TABLE A-continued

| Official Symbol: | Accession Number: | SEQ ID NO Forward Primer | Forward Primer Sequence: | SEQ ID NO Reverse Primer | Reverse Primer Sequence: | SEQ ID NO Probe | Probe Sequence: | SEQ ID NO Amplicon | Amplicon Sequence: |
|---|---|---|---|---|---|---|---|---|---|
| LAPTM5 | NM_006762 | 1445 | TGCTGGACTTCTG | 1446 | TGAGATAGTGGGCA | 1447 | TCCTGACCCTCTGCAGCTCC | 1448 | TGCTGGACTTCTGCCTGAGCATCCTGACCCTCTGCAG |
| LGALS3 | NM_002306 | 1449 | AGCCGAAAATGGC | 1450 | CTTGAGGGTTTGGGT | 1451 | ACCCAGATAACGCATCATGG | 1452 | AGCCGAAAATGGCAGACAATTTTCGCTCCATGATG |
| LIG3 | NM_002311 | 1453 | GGAGGTGAGAAG | 1454 | ACAGTGTCATCAGC | 1455 | CTGGACGCTCAGAGCTCGTC | 1456 | GGAGGTGAGAAGGAGCCGGGCCAGAGACGAGCTCT |
| LIMS1 | NM_004987 | 1457 | TGAACAGTAATGG | 1458 | TTCTGGGACTGCTG | 1459 | ACTGAGCGCACACGAAACA | 1460 | TGAACAGTAATGGGGAGCTGTACCATGAGCAGTGTT |
| LOX | NM_002317 | 1461 | CCAATGGGAGAAC | 1462 | CGCTCAGGCTGGTAC | 1463 | CAGGCTCAGCAAGCTGAACA | 1464 | CCAATGGGAGAACACGGCAGGTGTTCAGCTTGCT |
| LRP1 | NM_002332 | 1465 | TTTTGGCCCAATGGGCTAAG | 1466 | GTCTCGATGCGGTCGTAGAAG | 1467 | TCCCGGCTGGGCGCCTCTACT | 1468 | TTTTGGCCCAATGGGCTAAGCCTGACATCCCGGCTGGGCGCCTCTACTGGGTGGATGCCTTCTACGACCGCAT |
| LTBP2 | NM_000428 | 1469 | GCACACCCATCCT | 1470 | GATGGCTGGCCACGT | 1471 | CTTTGCAGCCCTCAGAACTC | 1472 | GCACACCCATCCTTGAGTCTCCTTTGCAGCCCTCAGA |
| LUM | NM_002345 | 1473 | GGCTCTTTTGAAGGATTGGTAA | 1474 | AAAAGCAGTGAAACAGCATC | 1475 | CCTGACCTTCATCCATCTCCAGCA | 1476 | GGCTCTTTTGAAGGATTGGTAAACCTGACCTTCATCCATCTCCAGCAATCGGCTGAAAGAGGATGCTGTTT |
| MAGEA4 | NM_002362 | 1477 | GCATCTAACAGCC | 1478 | CAGAGTGAAGAATGG | 1479 | CAGCTTCCCTTGCCTCGTGT | 1480 | GCATCTAACAGCCCTGTCCAGCAGCTTCCCTTGCCTC |
| MANF | NM_006010 | 1481 | CAGATGTGAAGCC | 1482 | AAGGGAATCCCCTCA | 1483 | TTCCTGATGATGCTGGCCCT | 1484 | CAGATGTGAAGCCTGGAGCTTTCCTGATGATGCTGG |
| MAOA | NM_000240 | 1485 | GTGTCAGCCAAAG | 1486 | CGACTACGTCGAACA | 1487 | CCGGATACTCGCCTTCTCT | 1488 | GTGTCAGCCAAAGCATGGAGAATCAAGAGAAGGCGA |
| MAP3K5 | NM_005923 | 1489 | AGGACCAAGAGGC | 1490 | CCTGTGGCCATTTCA | 1491 | CAGCCCAGAGACCAGATGTC | 1492 | AGGACCAAGAGGCTACGGAAAAGCAGCAGACATCTG |
| MAP3K7 | NM_145333 | 1493 | CAGGCAAGAACTAGTTGCAGAA | 1494 | CCTGTACCAGGCGAGATGTAT | 1495 | TGCTGGTCCTTTTCATCCCTGGTCC | 1496 | CAGGCAAGAACTAGTTGCAGAATGGACCAGGATGAAAAGGACCAGCAAAATACATCTCGCCTGGTACAGG |
| MAP4K4 | NM_004834 | 1497 | TCGCCGAGATTTC | 1498 | CTGTTGTCTCCGAAG | 1499 | AACGTTCCTTGTTCTCCTGC | 1500 | TCGCCGAGATTTCCTGAGACTGCAGCAGGAGAACAA |
| MAP7 | NM_003980 | 1501 | GAGGAACAGAGGT | 1502 | CTGCCAACTGGCTTTC | 1503 | CATGTACAACAAACGCTCCG | 1504 | GAGGAACAGAGGTGTCTGCACTTCCATGTACAACAA |

TABLE A-continued

| Official Symbol: | Accession Number: | SEQ ID NO | Forward Primer Sequence: | SEQ ID NO | Reverse Primer Sequence: | SEQ ID NO | Probe Sequence: | SEQ ID NO | Amplicon Sequence: |
|---|---|---|---|---|---|---|---|---|---|
| MAPKAPK3 | NM_004635 | 1505 | AAGCTGCAGAGATAATGCGG | 1506 | GTGGGCAATGTTATGGCTG | 1507 | ATTGGCACTGCCATCCAGTTTCTG | 1508 | AAGCTGCAGAGATAATGCGGGATATTGCACTGCCATCCAGTTTCTGCACAGCCATAACATTGCCCAC |
| MCM2 | NM_004526 | 1509 | GACTTTTGCCCGCTACCTTTC | 1510 | GCCACTAACTGCTTCAGTATGAAGAG | 1511 | ACAGCTCATTGTTGTCACGCCGGA | 1512 | GACTTTTGCCCGCTACCTTTCATTCCGCGTGACAACAATGAGCTGTTGCTCTTCATACTGAAGCAGTTAGTGG |
| MCM3 | NM_002388 | 1513 | GGAGAACAATCCC | 1514 | ATCTCCTGGATGGTG | 1515 | TGGCCTTTCTGTCTACAAGG | 1516 | GGAGAACAATCCCCTTGAGACAGAATATGGCCTTTC |
| MCM6 | NM_005915 | 1517 | TGATGGTCCTATGTGTCACATTCA | 1518 | TGGGACAGGAAACACACCAA | 1519 | CAGGTTTCATACCAACACAGGCTTCAGCAC | 1520 | TGATGGTCCTATGTGTCACATTCATCACAGGTTTCATACCAACACAGGCTTCAGCACTTCCTTTGGTGTGTTTC |
| MDK | NM_002391 | 1521 | GGAGCCGACTGCA | 1522 | GACTTTGGTGCCTGT | 1523 | ATCACACGCCACCCCAGTTCT | 1524 | GGAGCCGACTGCAAGTACAAGTTTGAGAACTGGGGT |
| MDM2 | NM_002392 | 1525 | CTACAGGGACGCC | 1526 | ATCCAACCAATCACC | 1527 | CTTACACCAGCATCAAGATC | 1528 | CTACAGGGACGCCATCGATTGGATCTTGATGCTG |
| MELK | NM_014791 | 1529 | AGGATCGCCTGTC | 1530 | TGCACATAAGCAACA | 1531 | CCCGGGTGTCTTCCGTCAG | 1532 | AGGATCGCCTGTCAGAGAGGAGACCCGGGTTGTCT |
| MET | NM_000245 | 1533 | GACATTTCCAGTCCTGCAGTCA | 1534 | CTCCGATCGCACATTTGT | 1535 | TGCCTCTCGCCCCACCCTTTGT | 1536 | GACATTTCCAGTCCTGCAGTCAATGCCTCTGCCCCACCCTTTGTTCAGTGGCTGTGCCACGACAAATGT |
| MGMT | NM_002412 | 1537 | GTGAAATGAAACG | 1538 | GACCCTGCTCACAAC | 1539 | CAGCCCTTTGGGGAAGCTGG | 1540 | GTGAAATGAAACGCACCACTGACAGCCCTTTGT |
| MGST1 | NM_020300 | 1541 | ACGGATCTACCACCATTGC | 1542 | TCCATATCCAACAAAAAAACTCAAAG | 1543 | TTTGACACCCCTTCCCAGCCA | 1544 | ACGGATCTACCACCATTGCATATTTGACACCCCTTCCCCAGCCAAATAGAGCTTTGAGTTTTTTTGTTGAT |
| MICA | NM_000247 | 1545 | ATGTGAATGTCA | 1546 | AAGCCAGAAGCCCTG | 1547 | CGAGGCCTCAGAGGCAAC | 1548 | ATGGTGAATGTCACCCGCAGCGAGGCCTCAGAGGGC |
| MKI67 | NM_002417 | 1549 | GATTGCACCAGGG | 1550 | TCCAAAGTGCCTCTG | 1551 | CCACTCTTCCTTGAACACCC | 1552 | GATTGCACCAGGGCAGAACAGGGGAGGGTGTTCAAG |
| MLXIP | NM_014938 | 1553 | TGCTTAGCTGGCA | 1554 | CAGCCTACTCTCCAT | 1555 | CATGAGATGCCAGGAGACCC | 1556 | TGCTTAGCTGGCATGGCCGCATGAGATGCCAGGA |
| MMP11 | NM_005940 | 1557 | CCTGGAGGCTGCAACATACC | 1558 | TACAATGGCTTTGAGGATAGCA | 1559 | ATCTCCTGAAGCCCTTTTCGCAGC | 1560 | CCTGGAGGCTGCAACATACCTCAATCCTGTCCCAGCCCGGATCCTCTCCGAAGCCCTTTTCGCAGCACTGCTAT |
| MMP2 | NM_004530 | 1561 | CAGCCAGAAGCGG | 1562 | AGACACCACCATCACCTG | 1563 | AAGTCCGAATCTGCTCCC | 1564 | CAGCCAGAAGCGGAAACTTAAAAGTCCGAATCTCT |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| MMP7 | NM_002423 | 1565 GGATGGTAGCAGTCTAGGGATTAACT | 1566 GGAATGTCCCATACCCAAAGAA | 1567 CCTGTATGCTGCAACTCATGAACTTGGC | 1568 GGATGGTAGCAGTCTAGGGATTAACTTCTGTATGCTGCAACTCATGAACTTGGCCATTCTTTGGGTATGGGAC |
| MMP9 | NM_004994 | 1569 GAGAACCAATCTC | 1570 CACCCGAGTGTAACC | 1571 ACAGGTATTCCTCTGCCAGC | 1572 GAGAACCAATCTCACCGACAGGCAGTCGCAGAGGA |
| MPPED2 | NM_001584 | 1573 CCGACCAACCCTC | 1574 AGGGCATTTAGAGCT | 1575 ATTTGACCTTCCAAACCCAC | 1576 CCGACCAACCCTCCAATTATATTTGACCTTCCAAACC |
| MRC1 | NM_002438 | 1577 CTTGACCTCAGGA | 1578 GGACTGCGGTCACTC | 1579 CCAACCGCTGTTGAAGCTCA | 1580 CTTGACCTCAGGACTCTGATTGGACTTAAACAGTCTG |
| MRPL13 | NM_014078 | 1581 TCCGGTTCCCTTCG | 1582 GTGGAAAAACTGCGG | 1583 CGGCTGGAAATTATGTCCTC | 1584 TCCGGTTCCCTTCGTTTAGGTCGGCTGGAAATTATGT |
| MSH2 | NM_000251 | 1585 GATGCAGAATTGA | 1586 TCTTGGCAGTCGGT | 1587 CAAGAGATTACTTCGTCG | 1588 GATGCAGAATTGAGGCAGACTTTACAAGAAGATTTA |
| MSH3 | NM_002439 | 1589 TGATTACCATCATGGCTCAGA | 1590 CTTGTGAAAATGCCATCCAC | 1591 TCCCAATTGTCGCTTCTTCTGCAG | 1592 TGATTACCATCATGGCTCAGATTGGCTCTCTATGTTCCTCAGAAGAAGCGACAATTGGGATTGTGATGGCAT |
| MSH6 | NM_000179 | 1593 TCTATTGGGGGAT | 1594 CAAATTGCGAGTGGT | 1595 CCGTTACCAGTGGAAATTC | 1596 TCTATTGGGGGATTGGTAGGAACCGTTACCAGCTGG |
| MTA1 | NM_004689 | 1597 CCGCCCTCACCTGAAGAGA | 1598 GGAATAAGTTAGCCGCGCTTCT | 1599 CCCAGTGTCCGCCAAGGAGCG | 1600 CCGCCCTCACCTGCAGAGAAACGCGCTCTTGGCGACACTGGGGGAGGAAGAAGCGCGGCTAACTT |
| MTPN | NM_145808 | 1601 GGTGGAAGGAAAC | 1602 CAGCAGCAGAAATTC | 1603 AAGCTGCCCACAATCTGCTG | 1604 GGTGGAAGGAAACCTCTTCATTATGCAGCAGATTGT |
| MTSS1 | NM_014751 | 1605 TTCGACAAGTCCT | 1606 CTTGGAACATCCGTC | 1607 CCAAGAAACAGCGACATCA | 1608 TTCGACAAGTCCTCCACCATTCAAGAAACAGCGAC |
| MUC1 | NM_002456 | 1609 GGCCAGGATCTGTGGTGGTA | 1610 CTCCACGTCCTGGACATTGA | 1611 CTCTGGCCTTCCGAGAAGGTACC | 1612 GGCCAGGATCTGTGGTGGTACAATTGACTCTGGCCTTCCGAGAAGGTACCATCAATGTCCACGACGTGGAG |
| MVP | NM_017458 | 1613 ACGAGAACGAGGGCATCTATGT | 1614 GCATGTAGGTGCTTCCAATCAC | 1615 CGCACCTTTCCGGTCTTGACATCCT | 1616 ACGAGAACGAGGGCATCTATGTCAGGATGTCAAGACCGAAAGTGCGCGTGTGATTGGAAGCACCTACA |
| MYBL2 | NM_002466 | 1617 GCCGAGATCGCCAAGATG | 1618 CTTTTGATGTAGAGTTCCAGTGATTC | 1619 CAGCATTGTCTGTCCTCCCTGGCA | 1620 GCCGAGATCGCCAAGATGTTGCCAGGAGGACAGACAATGCTGTGAAGAATCACTGGAACTCTACCATCAAA |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| MYBPC1 | NM_002465 | 1621 CAGCAACCAGGGA | 1622 CAGCAGTAAGTGCCT | 1623 AAATTCGCAAGCCCA GCCCC | 1624 CAGCAACCAGGGAGTCTGTACCCTGGAAATT CGCAA |
| MYC | NM_002467 | 1625 TCCCTCCACTCGGAAGGACTA | 1626 CGGTTGTTGCTGATCTGTCTCA | 1627 TCTGACACTGTCCAA CTTGACCCTCTT | 1628 TCCCTCCACTCGGAAGGACTATCCTGCTGCC AAGAGGGTCAAGTTGGACAGTGTCAGAGTCC TGAGACAGAT |
| MYLK3 | NM_182493 | 1629 CACCTGACTGAGCTGGATGT | 1630 GATGTAGTGCTGGTGTGCAGT | 1631 CACACCCTCACAGAT CTGCCTGGT | 1632 CACCTGACTGAGCTGGATGTGGTCCTGTTCA CCAGGCAGATCTGTGAGGGTGTGCATTACCT GCACCAGCACT |
| MYO6 | NM_004999 | 1633 AAGCAGTTCTGGA | 1634 GATGAGCTCGGCTTC | 1635 CAATCCTCAGGGCCA GCTCC | 1636 AAGCAGTTCTGGAGCAGGAGCGCAGGGACCG GGAGC |
| NCAM1 | NM_000615 | 1637 TAGTTCCCAGCTG | 1638 CAGCCTTGTTCTCAGC | 1639 CTCAGCCTCGTCGTT CTTAT | 1640 TAGTTCCCAGCTGACCACTCAAAAAGGTGAT AAGAA |
| NCAPD3 | NM_015261 | 1641 TCGTTGCTTAGAC | 1642 CTCCAGACAGTGTGC | 1643 CTACTGTCCGCAGCA AGGCA | 1644 TCGTTGCTTAGACAAGGCGCCTACTGTCCGC AGCAA |
| NCOR1 | NM_006311 | 1645 AACCGTTACAGCC | 1646 TCTGGAGAGACCCTT | 1647 CCAGGCTCAGTCTGT CCATC | 1648 AACCGTTACAGCCCAGAATCCCGGCTCAGT CTGTCC |
| NCOR2 | NM_006312 | 1649 CGTCATCTACGAA | 1650 GAGCACTGGGTCACA | 1651 CCTCATAGGACAAGA CGTGG | 1652 CGTCATCTACGAAGGCAAGAAGGCCACGTC TTGTC |
| NDRG1 | NM_006096 | 1653 AGGGCAACATTCC | 1654 CAGTGCTCCTACTCC | 1655 CTGCAAGGACACTCA TCACA | 1656 AGGGCAACATTCCACAGCTGCCCTGGCTGTG ATGAG |
| NDUFS5 | NM_004552 | 1657 AGAAGAGTCAAGG | 1658 AGGGCGAACCTTTTC | 1659 TGTCCAAGAAAGGCA TGGCT | 1660 AGAAGAGTCAAGGCCACGAGCATCGGGTAGC CATGC |
| NEK2 | NM_002497 | 1661 GTGAGGCAGCGCGACTCT | 1662 TGCCAATGGTGTACAACACTTCA | 1663 TGCCTTCCCGGGCTG AGGACT | 1664 GTGAGGCAGCGCGACTCTGGCGACTGGCCGG CCATGCCTTCCCGGGCTGAGGACTATGAAGT GTTGTACACC |
| NETO2 | NM_018092 | 1665 CCAGGGCACCATA | 1666 AACCGTAAATCAAGG | 1667 AGCCAACCCTTTTCT CCCAT | 1668 CCAGGGCACCATACTGTTTCCAGCAGCCAAC CCTTTT |
| NEXN | NM_144573 | 1669 AGGAGGAGGAAGA | 1670 GAGTCCTCAGATCTGG | 1671 TCATCTTTCAGCAGTG GAGCC | 1672 AGGAGGAGGAAGAAGGTAGCATCATGAATGG CTCCA |
| NFAT5 | NM_006599 | 1673 CTGAACCCCTCTC | 1674 AGGAAACGATGGCGA | 1675 CGAGAATCAGTCCCC GTGGA | 1676 CTGAACCCCTCTCCTTGGTCACCGAGAATCAG TCCCG |
| NFATC2 | NM_173091 | 1677 CAGTCAAGGTCAG | 1678 CTTTGGCTCGTGGCAT | 1679 CGGGTTCCTACCCCA CAGTC | 1680 CAGTCAAGGTCAGAGGCTGAGCCCGGGTTCC TACCC |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| NFKB1 | NM_003998 | 1681 CAGACCAAGGGAGA | 1682 AGCTGCCAGTGCTAT | 1683 AAGCTGTAAACATGA GCCGC | 1684 CAGACCAAGGAGATGGACCTCAGCGTGTGC GGCTC |
| NFKB1A | NM_020529 | 1685 CTACTGGACGACC | 1686 CCTTGACCATCTGCTC | 1687 CTCGTCTTTCATGGA GTCCA | 1688 CTACTGGACGACCGCCACGACAGCGGCCTGG ACTCC |
| NME1 | NM_000269 | 1689 CCAACCCTGCAGACTCCAA | 1690 ATGTATAATGTTCCTGCCAACTTG TATG | 1691 CCTGGGACCATCCGT GGAGACTTCT | 1692 CCAACCCTGCAGACTCCAAGCTCCAGGACCAT CCGTGGAGACTTCTGCATACAAGTTGGCAGG AACATTATAC |
| NNMT | NM_006169 | 1694 CCTAGGGCAGGGA | 1694 CTAGTCCAGCCAAAC | 1695 CCCTCTCCTCATGCC CAGAC | 1696 CCTAGGGCAGGGATGGAGAGAGAGTCTGGGC ATGAG |
| NOS3 | NM_000603 | 1697 ATCTCCGCCTCGC | 1698 TCGGAGCCATACAGG | 1699 TTCACTCGCTTCGCC ATCAC | 1700 ATCTCCGCCTCGTCATGGGCACGGTGATGG CGAAG |
| NOX4 | NM_016931 | 1701 CCTCAACTGCAGCCTTATCC | 1702 TGCTTGGAACCTTCTGTGAT | 1703 CCGAACACTCTTGGC TTACCTCCG | 1704 CCTCAACTGCAGCCTTATCCTCTTTACCATG TGCCGAACACTCTTGGCTTACCTCCGAGAT CACAGAAGGTTC |
| NPBWR1 | NM_005285 | 1705 TCACCAACCTGTT | 1706 GATGTTGATGGGCAG | 1707 ATCGCCGACGAGCTC TTCAC | 1708 TCACCAACCTGTTCATCCTCAACCTGGCCAT CGCCGA |
| NPM1 | NM_002520 | 1709 AATGTTGTCCAGGTTCTATTGC | 1710 CAAGCAAAGGGTGGAGTTC | 1711 AACAGGCATTTGGA CAACACATTCTTG | 1712 AATGTTGTCCAGGTTCTATTGCCAAGAATGT GTTGTCCAAAATGCCTGTTTAGTTTTTAAAG ATGGAACTCCAC |
| NRG1 | NM_013957 | 1713 CGAGACTCTCCTCATAGTGAAAGG TA | 1714 CTTGGCGTGTGGAAATCTACAG | 1715 ATGACCACCCCGGCT CGTATGTCA | 1716 CGAGACTCTCCTCATAGTGAAAGTATGTGT CAGCCATGACCACCCCGGCTCGTATGTCACC TGTAGATTTCC |
| NRIP3 | NM_020645 | 1717 CCCACAAGCATGA | 1718 TGCTCAATCTGGCCC | 1719 AGCTTTCTCTACCCC GGCAT | 1720 CCCACAAGCATGAAGGAGGAGAAAAGCTTTCTT ACCCC |
| NRP1 | NM_003873 | 1721 CAGCTCTCTCCACGCGATTC | 1722 CCCAGCAGCTCCATTCTGA | 1723 CAGGATCTACCCCGA GAGAGCCACTCAT | 1724 CAGCTCTCTCCACGCGATTCATCAGGATCTA CCCCGAGAGAGCCACTCATGGCGACTGGGG CTCAGAATGGA |
| NUP62 | NM_153719 | 1725 AGCCTCTTTGCGTCAATAGC | 1726 CTGTGGTCACAGGGGTACAG | 1727 TCATCTGCCACCACT GGACTCTCC | 1728 AGCCTCTTTGCGTCAATAGCAACTGCTCCAA CCTCATCTGCCACCACTGGACTCTCCCCCTG TACCCCTGTGAC |
| OAZ1 | NM_004152 | 1729 AGCAAGGACAGCT | 1730 GAAGACATGGTCGGC | 1731 CTGCTCCTCAGCGAA CTCCA | 1732 AGCAAGGACAGCTTTGCAGTTCTCCTGGAGT TCGCTG |
| OCLN | NM_002538 | 1733 CCCTCCCATCCGA | 1734 GACGCGGGAGTGTAG | 1735 CTCCTCCCTCGGTGA CCAAT | 1736 CCCTCCCATCCGAGTTTCAGGTGAATTGTC ACCGAG |

TABLE A-continued

| Official Symbol: | Accession Number: | SEQ ID NO | Forward Primer Sequence: | SEQ ID NO | Reverse Primer Sequence: | SEQ ID NO | Probe Sequence: | SEQ ID NO | Amplicon Sequence: |
|---|---|---|---|---|---|---|---|---|---|
| ODC1 | NM_002539 | 1737 | AGAGATCACCGGCGTAATCAA | 1738 | CGGGCTCAGCTATGATTCTCA | 1739 | CCAGCGTTGACAAATACTTTCCGTCA | 1740 | AGAGATCACCGGCGTAATCAACCAGCGTTGGACAAATACTTTCCGTCAGACTCTTGGAGTGAGAATCATAGCT |
| OLFML2 | NM_015441 | 1741 | CATGTTGGAAGGA | 1742 | CACCAGTTTGGTGGT | 1743 | TGGCCTGGATCCTGAAGC | 1744 | CATGTTGGAAGGAGCGTTCTATGGCCTGGATCTCCTG |
| OLFML3 | NM_020190 | 1745 | TCAGAACTGAGGC | 1746 | CCAGATAGTCTACCT | 1747 | CAGACGATTCCACTCTCCCGG | 1748 | TCAGAACTGAGGCCGACACCATCTCCGGAGAGTGG |
| OMD | NM_005014 | 1749 | CGCAAAACTCAAGACTATCCCA | 1750 | CAGTCACAGCCTCAATTCATT | 1751 | TCCGATGCACATTCAGCAACTCACC | 1752 | CGCAAACTCAAGACTATCCCAAATATTCGATGCACATTCAGCAACTCTACCTTCAGTTCAATGAAATTGAGG |
| OR51E1 | NM_152430 | 1753 | GCATGCTTTCAGG | 1754 | AGAAGATGGCCAGCA | 1755 | TCCTCATCTCCACCTCATCC | 1756 | GCATGCTTTCAGGCATTGACATCCTCATCTCCACCTC |
| OR51E2 | NM_030774 | 1757 | TATGGTGCCAAAA | 1758 | GTCCTTGTCACAGCT | 1759 | ACATAGCCAGCACCGTGTT | 1760 | TATGGTGCCAAAACCAAACAGATCAGAACACGGGTG |
| OSM | NM_020530 | 1761 | GTTTCTGAAGGGG | 1762 | AGGTGTCTGGTTTGG | 1763 | CTGAGCTGGCCTCCTATGCC | 1764 | GTTTCTGAAGGGGAGGTCACAGCCTGAGCTGGCCTC |
| PAGE1 | NM_003785 | 1765 | CAACCTGACGAAGTGGAATC | 1766 | CAGATGCTCCCTCATCCTCT | 1767 | CCAACTCAAAGTCAGGATTCTACACCTGC | 1768 | CAACCTGACGAAGTGGAATCACCAACTCAAAGTCAGGATTCTACACCTGCTGAAGAGAGAGGATGAGGA |
| PAGE4 | NM_007003 | 1769 | GAATCTCAGCAAGAGGAACCA | 1770 | GTTCTTCGATCGGAGGTGTT | 1771 | CCAACTGACAATCAGGATATTGAACCTGG | 1772 | GAATCTCAGCAAGAGGAACCACCAACTGACAATCAGGATATTGAACCTGGACAAGAGAGAAGGAACACCT |
| PAK6 | NM_020168 | 1773 | CCTTCCAGGTCACC | 1774 | GTCCCCTTCAGGCCAG | 1775 | AGTTTCAGGAAGGCTGCCCC | 1776 | CCTTCCAGGTCACCCACCAGCCAGTTTCAGGAAGGCTG |
| PATE1 | NM_138294 | 1777 | TGGTAATCCCTGG | 1778 | TCCACCTTATGCCTTT | 1779 | CAGCACAGTTCTTTAGGCAG | 1780 | TGGTAATCCCTGGTTAACCTTCATGGCTGCCTAAAG |
| PCA3 | NM_015342 | 1781 | CGTGATTGTCAGG | 1782 | AGAAAGGGGAGATGC | 1783 | CTGAGATGCTCCCTGCCTTC | 1784 | CGTGATTGTCAGGAGCAAGACCTGAGATGCTCCCTG |
| PCDHGB | NM_018927 | 1785 | CCCAGCGTTGAAG | 1786 | GAAACGCCAGTCCGT | 1787 | ATTCTTAAACAGCAAGCCCC | 1788 | CCCAGCGTTGAAGCAGATAAGAAGATTCTTAAACAG |
| PCNA | NM_002592 | 1789 | GAAGGTGTTGGAG | 1790 | GGTTTACACCGCTGG | 1791 | ATCCCAGCAGGCCTCGTTGA | 1792 | GAAGGTGTTGGAGGCACTCAAGGACCTCATCAACGA |
| PDE9A | NM_001001570 | 1793 | TTCCACAACTTCCGGCAC | 1794 | AGACTGCAGAGCCAGACCA | 1795 | TACATCATCTGGGCCACGCAGAAG | 1796 | TTCCACAACTTCCGGCACTGCTTCTGCCTGGCCCAGATGATGTACAGCATGGTCTTGGGCTCTGCAGTCT |

TABLE A-continued

| Official Symbol: | Accession Number: | SEQ ID NO | Forward Primer Sequence: | SEQ ID NO | Reverse Primer Sequence: | SEQ ID NO | Probe Sequence: | SEQ ID NO | Amplicon Sequence: |
|---|---|---|---|---|---|---|---|---|---|
| PDGFRB | NM_002609 | 1797 | CCAGCTCTTCCTTCC | 1798 | GGGTGGCTCTCACTT | 1799 | ATCAATGTCCCTGTC CGAGT | 1800 | CCAGCTCTTCCTTCCAGCTACAGATCAATGTC CCTGTC |
| PECAM1 | NM_000442 | 1801 | TGTATTTCAAGACCTCTGTGCACT T | 1802 | TTAGCCTGAGGAATTGCTGTGTT | 1803 | TTTATGAACCTGCCC TGCTCCCACA | 1804 | TGTATTTCAAGACCTCTGTGCACTTATTAT GAACCTGCCCTGCTCCCACAGAACACAGCAA TTCCTCAGGCT |
| PEX10 | NM_153818 | 1805 | GGAGAAGTTCCCTCCCCAG | 1806 | ATCTGTGTCCAGGCCCAC | 1807 | CTACCTTCGGCACTA CCGCTGAGC | 1808 | GGAGAAGTTCCCTCCCCAGAAGCTCATCTAC CTTCGGCACTACCGCTGAGCCGGCGCCCGGG TGGGCCTGAC |
| PGD | NM_002631 | 1809 | ATTCCCATGCCCT | 1810 | CTGGCTGGAAGCATC | 1811 | ACTGCCCTCTCCTTC TATGA | 1812 | ATTCCCATGCCCCTGTTTTACCATGCCCCTCT CCTTCT |
| PGF | NM_002632 | 1813 | GTGGTTTCCCTCG | 1814 | AGCAAGGGAACAGCC | 1815 | ATCTTCTCAGACGTC CCGAG | 1816 | GTGGTTTCCCTCGGAGCCCCCTGGCTCGG ACGTCT |
| PGK1 | NM_000291 | 1817 | AGAGCCAGTTGCTGTGTAGAACTCAA | 1818 | CTGGGCCTACACAGTCCTTCA | 1819 | TCTCTGCTGGGCAAG GATGTTCTGTTC | 1820 | AGAGCCAGTTGCTGTAGAACTCAAATCTG CTGGGCCAAGGATGTTCTGTTCTGAAGGACT GTGTAGGCCCA |
| PGR | NM_000296 | 1821 | GATAAAGGAGCCG | 1822 | TCACAAGTCCGGCAC | 1823 | TAAAATTGCCGTCGCA GCCGC | 1824 | GATAAAGGAGCCCGTGTCACTAAATTGCCG TCGCA |
| PHTF2 | NM_020432 | 1825 | GATATGGCTGATG | 1826 | GGTTTGGGTGTTCTTG | 1827 | ACAATCTGGCAATGC ACAGT | 1828 | GATATGGCTGATGCTGCTGGGAACTGTG CATTGC |
| PIK3C2A | NM_002645 | 1829 | ATACCAATCACCGCCACAAACC | 1830 | CACACTAGACATTTCTCCGCATA | 1831 | TGTGCTGTGACTGGA CTTAACAAATAGCCT | 1832 | ATACCAATCACCGCACAAACCCAGGCTATTT GTTAAGTCCAGTCACAGCACAAAGAAACATA TGCCGAGAAAA |
| PIK3CA | NM_006218 | 1833 | GTGATTGAAGAGC | 1834 | GTCCTGCGTGGGAAT | 1835 | TCCTGCTTCTCGGGA TACAG | 1836 | GTGATTGAAGAGCATGCCAATTGTTCTGTAT CCCGA |
| PIK3CG | NM_002649 | 1837 | GGAGAACTCAATG | 1838 | TGATGCTTAGGCAGG | 1839 | TTCTGACAATTACT GCCAC | 1840 | GGAGAACTCAATGTCCATTCCATTCTTCTG GACAAT |
| PIM1 | NM_002648 | 1841 | CTGCTCAAGGACA | 1842 | GGATCCACTCTGGAG | 1843 | TACACTCGGGTCCCA TCGAA | 1844 | CTGCTCAAGGACACCGTCTACACGGACTTCG ATGGG |
| PLA2G7 | NM_005084 | 1845 | CCTGGCTGTGGTT | 1846 | TGACCCATGCTGATG | 1847 | TGGCAATACATAAAT CCTGT | 1848 | CCTGGCTGTGGTTTATCTTTTGACTGGCAA TACATA |
| PLAU | NM_002658 | 1849 | GTGGATGTGCCCT | 1850 | CTGCGGATCCAGGGT | 1851 | AAGCCAGGCGTCTAC ACGAG | 1852 | GTGGATGTGCCCTGAAGGACAAGCCAGGCGT CTACA |
| PLAUR | NM_002659 | 1853 | CCCATGGATGCTC | 1854 | CCGGTGGCTACCAGA | 1855 | CATTGACTGCCGAGG CCCCA | 1856 | CCCATGGATGCTCCTCTGAAGAGACTTTCCT CATTGA |

TABLE A-continued

| Official Symbol: | Accession Number: | SEQ ID NO | Forward Primer Sequence: | SEQ ID NO | Reverse Primer Sequence: | SEQ ID NO | Probe Sequence: | SEQ ID NO | Amplicon Sequence: |
|---|---|---|---|---|---|---|---|---|---|
| PLG | NM_000301 | 1857 | GGCAAAATTTCCA | 1858 | ATGTATCCATGAGCG | 1859 | TGCCAGGCCTGGGACTCTCA | 1860 | GGCAAAATTTCCAAGACCATGTCTGGACTGGAATGC |
| PLK1 | NM_005030 | 1861 | AATGAATACAGTATTCCCAAGCACAT | 1862 | TGTCTGAAGCATCTTCTGGATGA | 1863 | AACCCCGTGGCCCGCCTCC | 1864 | AATGAATACAGTATTCCCAAGCACATCAACCCGTGGCCGCCTCCCTCCATCCAGAAGATGCTTCAGACA |
| PLOD2 | NM_000935 | 1865 | CAGGGAGGTGGTTGCAAAT | 1866 | TCTCCCAGGATGCATGAAG | 1867 | TCCAGCCTTTTCGTGGTGACTCAA | 1868 | CAGGGAGGTGGTTGCAAATTTCTAAGGTACAATTGCTCTATTGAGTCACCACGAAAAGGCTGGAGCTTCATG |
| PLP2 | NM_002668 | 1869 | CCTGATCTGCTTCA | 1870 | GCAGCAAGGATCATC | 1871 | ACACCAGGCTACTCCTCCCT | 1872 | CCTGATCTGCTTCAGTGCCTCCCACCAGGCTACTCC |
| PNLIPRP | NM_005396 | 1873 | TGGAGAAGGTGAA | 1874 | CACGGCTTGGGTGTA | 1875 | ACCCGTGCCTCCAGTCCACA | 1876 | TGGAGAAGGTGAACTGCATCTGTGTGGACTGGAGGC |
| POSTN | NM_006475 | 1877 | GTGGCCCAATTAG | 1878 | TCACAGGTGCCAGCA | 1879 | TTTCTCCATCTGGCCTCAGAG | 1880 | GTGGCCCAATTAGGCTTGGCATCTGCTCTGAGGCCA |
| PPAP2B | NM_003713 | 1881 | ACAAGCACCATCC | 1882 | CACGAAGAAAACTA | 1883 | ACCAGGGCTCCTTGAGCAAA | 1884 | ACAAGCACCATCCAGTGATGTTCTGGCAGGATTTGC |
| PPFIA3 | NM_003660 | 1885 | CCTGGAGCTCCGT | 1886 | AGCCACATAGGGATC | 1887 | CACCCACTTTACCTCTGGT | 1888 | CCTGGAGCTCCGTGTTACTCTCAGGCACCCACTTTACCT |
| PPP1R12A | NM_002480 | 1889 | CGGCAAGGGGTTGATATAGA | 1890 | TGCCTGGCATCTCTAAGCA | 1891 | CCGTTCTTCTTCCTTTCGAGCTGC | 1892 | CGGCAAGGGGTTGATATAGAAGCAGCTCGAAAGGAAGAACGGATCATGCTTAGAGATGCCAGGCA |
| PPP3CA | NM_000944 | 1893 | ATACTCCCGAGCCC | 1894 | GGAAGCCCTGTTGTTT | 1895 | TACATGCGGTACCCTGCATC | 1896 | ATACTCCCGAGCCCACGAGCCCAAGATGCAGGTAC |
| PRIMA1 | NM_178013 | 1897 | ATCCTCTTCCCTGA | 1898 | CCCAGCTGAGAGGGA | 1899 | TGACGCATCCAGGGCTCTAG | 1900 | ATCCTCTTCCCTGAGCCGCTGACGCCATCCAGGGCTCT |
| PRKAR1 | NM_002735 | 1901 | ACAAAACCATGAC | 1902 | TGTCATCCAGGTGAG | 1903 | AAGGCCATCTCCAAGAACGT | 1904 | ACAAAACCATGACGTGCGCTGGCCAAGGCCATCTCCA |
| PRKAR2B | NM_002736 | 1905 | TGATAATCGTGGGAGTTTCG | 1906 | GCACCAGGAGAGGTAGCAGT | 1907 | CGAACTGGCCTTAATGTACAATACACCCA | 1908 | TGATAATCGTGGGAGTTTCGGCCTTAATGTACAATACACCCAGAGCAGCTACAATCACTGCTAC |
| PRKCA | NM_002737 | 1909 | CAAGCAATGCGT | 1910 | GTAAATCCGCCCCT | 1911 | CAGCCTCTGCGCGAATGGATC | 1912 | CAAGCAATGCGTCATCAATGTCCCCAGCTCTGCGG |
| PRKCB | NM_002738 | 1913 | GACCCAGCTCCAC | 1914 | CCCATTCACGTACTCC | 1915 | CCAGACCATGGACCGCCTGT | 1916 | GACCCAGCTCCACTCCTGCTTCCAGACCATGGACCGC |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| PROM1 | NM_006017 | 1917 CTATGACAGGCAT | 1918 CTCCAACCATGAGGA | 1919 ACCCGAGGCTGTGTCTCCAA | 1920 CTATGACAGGCATGCCACCCGACCACCCGAGGCTG |
| PROS1 | NM_000313 | 1921 GCAGCACAGGAAT | 1922 CCCACCTATCCAACCT | 1923 CTCATCCTGACAGACTGCAG | 1924 GCAGCACAGGAATTCTTCTTGGCAGCTGCAGTCTG |
| PSCA | NM_005672 | 1925 ACCGTCATCAGCAAAGGCT | 1926 CGTGATGTCTTCTTGCCC | 1927 CCTGTGAGTCATCCACGCAGTTCA | 1928 ACCGTCATCAGCAAAGGCTGCTGGATGACTCACAGGACTACTACGTGGGCAAGAAGAAC |
| PSMD13 | NM_002817 | 1929 GGAGGAGTCTACACGAGAAG | 1930 CGGATCCTGCACAAAATCA | 1931 CCTGAAGTGTCAGCTGATGCCACA | 1932 GGAGGAGTCTACACGAAGAAGTTGTGGCATCAGCTGACACTTCAGGTGCTTGATTTTGTGCAGGATCCG |
| PTCH1 | NM_000264 | 1933 CCACGACAAAGCC | 1934 TACTCGATGGGCTCT | 1935 CCTGAAACAAGGCTGAGAAT | 1936 CCACGACAAAGCCCGACTACATGCCTGAAACAAGGCT |
| PTEN | NM_000314 | 1937 TGGCTAAGTGAAGATGACAATCATG | 1938 TGCACATATCATTACACCAGTTCGT | 1939 CCTTTCCAGTTTACAGTGAATTGCTGCA | 1940 TGGCTAAGTGAAGATGACAATCATGTTGCAGCAATTCACTGTAAAGCTGAAAGGGACGAACTGGTGTAATG |
| PTGER3 | NM_000957 | 1941 TAACTGGGCAAC | 1942 TTGCAGGAAAAGTG | 1943 CCTTTGCCTTCCTGGGGCTC | 1944 TAACTGGGCAACCTTTCTTCCGCCTCTGCCTTTGCC |
| PTGS2 | NM_000963 | 1945 GAATCATTCACCAGGCAAATTG | 1946 CTGTACTGCGGGTGAACAT | 1947 CCTACCACCAGCAACCCTGCCA | 1948 GAATCATTCACCAGGCAAATTGCTGGAGGGTTGCTGGTGGTGTAGGAATGTTCCACCCGCAGTACAG |
| PTH1R | NM_000316 | 1949 CGAGGTACAAGCTGAGATCAAGAA | 1950 GCGTGCCTTTCGCTTGAA | 1951 CCAGTGCCAGTGTCCAGCGGCT | 1952 CGAGGTACAAGCTGAGATCAAGAAATCTTGGAGCCGCTGGACACTGGCACTTCAAGCGAAAGGCACG |
| PTHLH | NM_002820 | 1953 AGTGACTGGGAGTGGGCTAGAA | 1954 AAGCCTGTTACCGTGAATCGA | 1955 TGACACCTCCACAACGTCGCTGGA | 1956 AGTGACTGGGAGTGGGCTAGAAGGGGACCACCTGTCTGACACCTCCACAACGTCGCTGGAGCTCGATTCACG |
| PTK2 | NM_005607 | 1957 GACCGGTCGAATG | 1958 CTGGACATCTCGATG | 1959 ACCAGGCCCGTCACATTCTC | 1960 GACCGGTCGAATGATAAGGTGTACAGAGAATGTGACG |
| PTK2B | NM_004103 | 1961 CAAGCCCAGCCGA | 1962 GAACCTGGAACTGCA | 1963 CTCCGCAAACCAACCTCCTG | 1964 CAAGCCCAGCCGACCTAAGTACAGACCCCCTCCGCA |
| PTK6 | NM_005975 | 1965 GTGCAGGAAAGGTTCACAAA | 1966 GCACACACGATGAGTAAGG | 1967 AGTGTCTGCCTCCAATACACGGT | 1968 GTGCAGGAAAGGTTCACAAATGTGGAGTGTCTGCGTCCAATACACGGTGTGCTCCTCTCCTTACTCCATCGT |
| PTK7 | NM_002821 | 1969 TCAGAGGACTCA | 1970 CATACACCTTCCACGC | 1971 CGCAAGGTCCCATTCTTGAA | 1972 TCAGAGGACTCACGTTCGAGGTCTTCAAGAATGGG |

TABLE A-continued

| Official Symbol: | Accession Number: | SEQ ID NO Forward Primer | Sequence: | SEQ ID NO Reverse Primer | Sequence: | SEQ ID NO Probe | Sequence: | SEQ ID NO Amplicon | Sequence: |
|---|---|---|---|---|---|---|---|---|---|
| PTPN1 | NM_002827 | 1973 | AATGAGGAAGTTT | 1974 | CTTCGATCACAGCCA | 1975 | CTGATCCAGACAGCC GACCA | 1976 | AATGAGGAAGTTTCGGATGGGCTGATCCAG ACAGC |
| PTPRK | NM_002844 | 1977 | TCAAACCCTCCCA | 1978 | AGCAGCCAGTTCGTC | 1979 | CCCCATCGTTGTACA TTGCA | 1980 | TCAAACCCTCCCAGTGCTGCCCCATCGTTG TACATT |
| PTTG1 | NM_004219 | 1981 | GGCTACTCTGATCTATGTTGATAA GG | 1982 | GCTTCAGCCCATCCTTAGCA | 1983 | CACACGGGTGCCTGG TTCTCCA | 1984 | GGCTACTCTGATCTATGTTGATAAGGAAAAT GGAGAACCAGGCACCCGTGGTTGCTAAGG ATGGGCTGAA |
| PYCARD | NM_013258 | 1985 | CTTTATAGACCAG | 1986 | AGCATCCAGCAGCCA | 1987 | ACGTTTGTGACCCTC GCGAT | 1988 | CTTTATAGACCAGCACCGGGCTGCGCTTATC GCGAG |
| RAB27A | NM_004580 | 1989 | TGAGAGATTAATG | 1990 | CCGGATGCTTATTCG | 1991 | ACAAATTGCTTCTCA CCATC | 1992 | TGAGAGATTAATGGGCATTGTGTACAAATTG CTTCTC |
| RAB30 | NM_014488 | 1993 | TAAAGGCTGAGGC | 1994 | CTCCCCAGCATCTCAT | 1995 | CCATCAGGGCAGTTG CTGAT | 1996 | TAAAGGCTGAGGCACGGAGGAAGAAAAGGAAT CAGCA |
| RAB31 | NM_006868 | 1997 | CTGAAGGACCCTA | 1998 | ATGCAAAGCCAGTGT | 1999 | CTTCTCAAAGTGAGG TGCCA | 2000 | CTGAAGGACCCTACGCTCGTCGTGCCTGGCAC CTCAC |
| RAD21 | NM_006265 | 2001 | TAGGGATGGTATCTGAAACAACA | 2002 | TCGCGTACACCTCTGCTC | 2003 | CACTTAAAACGAATC TCAAGAGGGTGACCA | 2004 | TAGGGATGGTATCTGAAACAACAATGGTCAC CCTCTTGAGATTCGTTTTAAGTGTAATTCCA TAATGAGCAGAG |
| RAD51 | NM_002875 | 2005 | AGACTACTCGGGT | 2006 | AGCATCCGCAGAAAC | 2007 | CTTTCAGCCAGGCAG ATGCA | 2008 | AGACTACTCGGGTCGAGGTGAGCTTTCAGCC AGGCA |
| RAD9A | NM_004584 | 2009 | GCCATCTTCACCA | 2010 | CGGTGTCTGAGAGTG | 2011 | CTTTGCTGGACGGCC ACTTT | 2012 | GCCATCTTCACCATCAAGGACTCTTTGCTGG ACGGCC |
| RAF1 | NM_002880 | 2013 | CGTCGTATGCGAG | 2014 | TGAAGGCGTGAGGTG | 2015 | TCCAGGATGCCTGTT AGTTC | 2016 | CGTCGTATGCGAGATCTGTTTCCAGGATGCC TGTTA |
| RAGE | NM_014226 | 2017 | ATTAGGGGACTTT | 2018 | GGGTCGGAGATGTATT | 2019 | CCGGAGTGTCTATTC CAAGC | 2020 | ATTAGGGGACTTTGGCTCCTCTGCCGAGTGTC TATTCC |
| RALA | NM_005402 | 2021 | TGGTCCTGAATGT | 2022 | CCCCATTTCACCTCTT | 2023 | TTGTGTTTCTTGGGC AGTCT | 2024 | TGGTCCTGAATGTAGCGTGTAAGCTTGTTGTT TCTTGG |
| RALBP1 | NM_006788 | 2025 | GGTGTCAGATATAAATGTGCAAAT GC | 2026 | TTCGATATTGCCAGCAGCTATAAA | 2027 | TGCTGTCCTGTCGT CTCAGTACGTTCA | 2028 | GGTGTCAGATATAAATGTGCAAATGCCTTCT TGCTGTCCTGTCGTCCAGTACGTTCACTT TATAGCTGCTGG |
| RAP1B | NM_001010942 | 2029 | TGACAGCGTGAGAGGTACTAGG | 2030 | CTGAGCCAAGAACGACTAGCTT | 2031 | CACGCATGATGCAAG CTTGTCAAA | 2032 | TGACAGCGTGAGAGGTACTAGGTTTTGACAA GCTTGCATCATGCGTGAGTATAAGCTAGTCG TTCTTGGCTCA |

TABLE A-continued

| Official Symbol: | Accession Number: | SEQ ID NO | Forward Primer Sequence: | SEQ ID NO | Reverse Primer Sequence: | SEQ ID NO | Probe Sequence: | SEQ ID NO | Amplicon Sequence: |
|---|---|---|---|---|---|---|---|---|---|
| RARB | NM_000965 | 2033 | ATGAACCCTTGACCCCAAGT | 2034 | GAGCTGGGTGAGATGCTAGG | 2035 | TGTGCTTCTGCTTGT TCCCACTTG | 2036 | ATGAACCCTTGACCCCAAGTTCAAGTGGAA CACAGCAGAGCACAGTCCTTAGCATCTTCACCC AGCTC |
| RASSF1 | NM_007182 | 2037 | AGGGCACGTGAAGTCATTG | 2038 | AAAGAGTGCAAACTTGCGG | 2039 | CACCACCAAGAGACTT TCGCAGCAG | 2040 | AGGGCACGTGAAGTCATTGAGGCCTGCTGC GAAAGTTCTTGGTGGTGGATGACCCCGCAA GTTTGCACTCT |
| RB1 | NM_000321 | 2041 | CGAAGCCCTTACA | 2042 | GGACTCTTCAGGGGT | 2043 | CCCTTACGGATTCCT GGAGG | 2044 | CGAAGCCCTTACAAGTTTCCTAGTTCACCCT TACGGA |
| RECK | NM_021111 | 2045 | GTCGCCGAGTGTG | 2046 | GTGGGATGATGGGT | 2047 | TCAAGTGTCCTTGC TCTTG | 2048 | GTCGCCGAGTGTGCTTCTCTCAAGTGTCTT CGCTCT |
| REG4 | NM_032044 | 2049 | TGCTAACTTCCTGCACAGCC | 2050 | TGCTAGGTTTCCCCTCTGAA | 2051 | TCCTCTTCCTTTCTGC TAGCCTGGC | 2052 | TGCTAACTTCCTGCACAGCCCCTCCTCTTCC TTTCTGCTAGCCTGGCTAAATCTGCTCATTA TTTCAGAGGGGA |
| RELA | NM_021975 | 2053 | CTGCCCGGGATGGC | 2054 | CCAGGTTCTGGAAAC | 2055 | CTGAGCTCTGCCCGG ACCGC | 2056 | CTGCCCGGGATGGCTTCTATGAGGCTGAGCTC TGCCC |
| RFX1 | NM_002918 | 2057 | TCCTCTCCAAGTTC | 2058 | CAGGCCCTGGTACAG | 2059 | TCCAATGGACCAAGC ACTGT | 2060 | TCCTCTCCAAGTTCGAGCCCTGCTCCAATG GACCAA |
| RGS10 | NM_001005339 | 2061 | AGACATCCACGACAGCGAT | 2062 | CCATTTGGCTGTGCTCTTG | 2063 | AGTTCCAGCAGCAGC CACCAGAG | 2064 | AGACATCCACGACAGCGATGGCAGTTCCAGC AGCAGCCACCAGAGCCTCAAGAGCACAGCCA AATGG |
| RGS7 | NM_002924 | 2065 | CAGGCTGCAGAGAGCATTT | 2066 | TTTGCTTGTGTCTTCTGCTTG | 2067 | TGAAAATGAACTCCC ACTTCCGGG | 2068 | CAGGCTGCAGAGAGCATTTGCCCGGAAGTGG GAGTTCATTTTCATGCAAGCAGAAGCACAAG CAAA |
| RHOA | NM_001664 | 2069 | TGGCATAGCTCTG | 2070 | TGCCACAGCTGCATG | 2071 | AAATGGGCTCAACC AGAAA | 2072 | TGGCATAGCTCTGGGGTGGCAGTTTTTTGA AAATG |
| RHOB | NM_004040 | 2073 | AAGCATGAACAGG | 2074 | CCTCCCAAGTCAGT | 2075 | CTTTCCAACCCCTGG GGAAG | 2076 | AAGCATGAACAGGACTTGACCATCTTCCAA CCCCTG |
| RHOC | NM_175744 | 2077 | CCCGTTCGGTCTG | 2078 | GAGCACTCAAGGTAG | 2079 | TCCGGTTCGCCATG TCCCG | 2080 | CCCGTTCGGTCTGAGGAAGGCCGGACATGG CGAAC |
| RLN1 | NM_006911 | 2081 | AGCTGAAGGCAGCCCTATC | 2082 | TTGGAATCCTTTAATGCAGGT | 2083 | TGAGAGGCAACCATC ATTACCAGAGC | 2084 | AGCTGAAGGCAGCCCTATCTGAGAGGCACC ATCATTACCAGAGCTACAGCAGTATGTACCT GCATTAAAGG |
| RND3 | NM_005168 | 2085 | TCGGAATTGGACT | 2086 | CTGGTTACTCCCCTCC | 2087 | TTTTAAGCCTGACTC CTCAC | 2088 | TCGGAATTGGACTTGGGAGGCGCCGTGAGGA GTCAG |
| RNF114 | NM_018683 | 2089 | TGACAGGGGAAGT | 2090 | GGAGAGACAGCTTTGG | 2091 | CCAGGTCAGCCCTTC TCTTC | 2092 | TGACAGGGGAAGTGGTCCCCAGTCAGCCC TTCTC |

TABLE A-continued

| Official Symbol: | Accession Number: | SEQ ID NO Forward Primer Sequence: | Forward Primer Sequence | SEQ ID NO Reverse Primer Sequence: | Reverse Primer Sequence | SEQ ID NO Probe Sequence: | Probe Sequence | SEQ ID NO Amplicon Sequence: | Amplicon Sequence |
|---|---|---|---|---|---|---|---|---|---|
| ROBO2 | NM_002942 | 2093 | CTACAAGGCCCCAG | 2094 | CACCAGTGCTTTAC | 2095 | CTGTACCATCCACTG CCAGC | 2096 | CTACAAGGCCCAGCCAACCAAACGCTGCAG TGGAT |
| RRM1 | NM_001033 | 2097 | GGGCTACTGGCAG | 2098 | CTCTTCAGCATCGGTA | 2099 | CATTGGATTGCCAT TAGTC | 2100 | GGGCTACTGGCAGCTACATTGCTGGGACTAA TGGCA |
| RRM2 | NM_001034 | 2101 | CAGCGGGATTAAA | 2102 | ATCTGCGTTGAAGCA | 2103 | CCAGCACAGCCAGTT AAAAG | 2104 | CAGCGGGATTAAACAGTCCTTTAACCAGCAC AGCCA |
| S100P | NM_005980 | 2105 | AGACAAGGATGCC | 2106 | GAAGTCCACCTGGGC | 2107 | TTGCTCAAGGACCTG GACGC | 2108 | AGACAAGGATGCCGTGGATAAATTGCTCAAG GACCT |
| SAT1 | NM_002970 | 2109 | CCTTTTACCACTGC | 2110 | ACAATGCTGTGTCCTT | 2111 | TCCAGTGCTCTTTCG GCACT | 2112 | CCTTTTACCACTGCCTGTTGCAGAAGTGCC GAAAGA |
| SCUBE2 | NM_020974 | 2113 | TGACAATCAGCACACCTGCAT | 2114 | TGTGACTACAGCCGTGATCCTTA | 2115 | CAGGCCCTCTTCCGA GCGGT | 2116 | TGACAATCAGCACACCTGCATTCACCGCTCG GAAGAGGGCCTGAGCTGCATGAATAAGGATC ACGGCTGTAG |
| SDC1 | NM_002997 | 2117 | GAAATTGACGAGG | 2118 | AGGAGCTAACGGAGA | 2119 | CTCTGAGCGCCTCCA TCCAA | 2120 | GAAATTGACGAGGGTGTCTTGGGCAGAGCT GGCTC |
| SDC2 | NM_002998 | 2121 | GGATTGAAGTGGC | 2122 | ACCAGCCACAGTACC | 2123 | AACTCCATCTCCTTC CCCAG | 2124 | GGATTGAAGTGGCTGGAAAGAGTGATGCCTG GGGAA |
| SDHC | NM_003001 | 2125 | CTTCCCTCGGGTCT | 2126 | TTCCCTCCTGGTAAA | 2127 | TTACATCCTCCCTCT CCCCG | 2128 | CTTCCCCTCGGGTCTCAGGCATTACATCCTC CCTCTC |
| SEC14L1 | NM_001039573 | 2129 | AGGGTTCCCATGTGACCAG | 2130 | GCAGGCATGCTGTGAAT | 2131 | CGGGCTTCTACATCC TGCAGTGG | 2132 | AGGGTTCCCATGTGACCAGGTGCCGGGCTT CTACATCCTGCAGTGGAAATTCCACAGCATG CCTGC |
| SEC23A | NM_006364 | 2133 | CGTGTGCATTAGA | 2134 | CCCATTACCATGTATC | 2135 | TCCTGGAGATGAAAT GCTGT | 2136 | CGTGTGCATTAGATCAGACAGGTCTCCTGA GATGA |
| SEMA3A | NM_006080 | 2137 | TTGGAATGCAGTC | 2138 | CTCTTCATTTCGCCTC | 2139 | TTGCCAATAGACCAG CGCTC | 2140 | TTGGAATGCAGTCCGAAGTCGCAGAGACGC TGGTC |
| SEPT9 | NM_006640 | 2141 | CAGTGACCACAGAG | 2142 | CTTCGATGGTACCCC | 2143 | TTGCCAATAGACCAG CGCTC | 2144 | CAGTGACCACCACGAGTACCAGGTCAACGGCAAG AGGAT |
| SERPINA3 | NM_001085 | 2145 | GTGTGGCCCTGTCTGCTTA | 2146 | CCCTGTGCATGTGAGAGCTAC | 2147 | AGGGAATCGCTGTCA CCTTCCAAG | 2148 | GTGTGGCCCTGTCTGCTTATCCTTGGAAGGT GACAGCGATTCCCTGTGTAGCTCTCACATGC ACAGGG |
| SERPINB5 | NM_002639 | 2149 | CAGATGGCCACTTTGAGAACATT | 2150 | GGCAGCATTAACCACAAGGATT | 2151 | AGCTGACAACAGTGT GAACGACCAGACC | 2152 | CAGATGGCCACTTTGAGAACATTTAGCTGA CAACAGTGTGAACGACCAGACCAAAATCCTT GTGGTTAATG |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| SESN3 | NM_144665 | 2153 GACCCTGGTTTTG | 2154 GAGCTCGGAATGTTG | 2155 TGCTCTTCTCCTCGT CTGGC | 2156 GACCCTGGTTTTGGGTATGAAGACTTTGCCA GACGA |
| SFRP4 | NM_003014 | 2157 TACAGGATGAGGC | 2158 GTTGTTAGGGCAAGG | 2159 CCTGGGACAGCCTAT GTAAG | 2160 TACAGGATGAGGCTGGGCATTGCCTGGGACA GCCTA |
| SH3RF2 | NM_152550 | 2161 CCATCACAACAGCCTTGAAC | 2162 CACTGGGGTGCTGATCTCTA | 2163 AACCGGATGGTCCAT TCTCCTTCA | 2164 CCATCACAACAGCCTTGAACACTTCAACCG GATGGTCCATTCTCCTTCAGGGCGCCATATG GTAGAGATCAG |
| SH3YL1 | NM_015677 | 2165 CCTCCAAAGCCAT | 2166 CTTTCAGAGCCAGAG | 2167 CACAGCAGTCATCTG CACCA | 2168 CCTCCAAAGCCATTGTCAAGACCACCAGCAGT CATCT |
| SHH | NM_000193 | 2169 GTCCAAGGCACAT | 2170 GAAGCAGCCTCCCGA | 2171 CACCGAGTTCTCTGC TTTCA | 2172 GTCCAAGGCACATATCCACTGCTCGGTGAAA GCAGA |
| SHMT2 | NM_005412 | 2173 AGCGGGTGCTAGA | 2174 ATGGCACTTCGGTCT | 2175 CCATCACTGCCAACA AGAAC | 2176 AGCGGGTGCTAGAGCTTGTATCCATCACTGC CAACA |
| SIM2 | NM_005069 | 2177 GATGGTAGGAAGG | 2178 CACAAGGAGCTGTGA | 2179 CGCCTCTCCACGCAC TCAGC | 2180 GATGGTAGGAAGGATGTGCCCGCCTCTCCA CGCAC |
| SIPA1L1 | NM_015556 | 2181 CTAGGACAGCTTG | 2182 CATAACCGTAGGGCT | 2183 CGGCACAATGCCCTC ATAGT | 2184 CTAGGACAGCTTGCTTCCATGTCAACTATG AGGGC |
| SKIL | NM_005414 | 2185 AGAGGCTGAATAT | 2186 CTATCGGCCTCAGCA | 2187 CCAAATCTGCCTCA GTTCT | 2188 AGAGGCTGAATATGCAGGACAGTTGGCAGAA CTGAG |
| SLC22A3 | NM_021977 | 2189 ATCGTCAGCGAGT | 2190 CAGGATGGCTTGGGT | 2191 CAGCATCCACGCATT GACAC | 2192 ATCGTCAGCGAGTTTGACTTGTCTGTGTCA ATGCGT |
| SLC25A21 | NM_030631 | 2193 AAGTGTTTTTCCCCCTTGAGAT | 2194 GGCCGATCGATAGTCTCTCTT | 2195 TCATGTGCTGCATA GCAAATATCCA | 2196 AAGTGTTTTTCCCCCTTGAGATAATGGATAT TTGCTATGCAGCACCATGAAGAAGAGACT ATCGATCGGCC |
| SLC44A1 | NM_080546 | 2197 AGGACCGTAGCTG | 2198 ATCCCCATCCCAATGC | 2199 TACCATGGCTGCTGC TCTTC | 2200 AGGACCGTAGCTGCACAGACATACCATGGCT GCTGC |
| SMAD4 | NM_005359 | 2201 GGACATTACTGGC | 2202 ACCAATACTCAGGAG | 2203 TGCATTCCAGCCTCC CATTT | 2204 GGACATTACTGGCCTGTTCACAATGAGCTTG CATTCC |
| SMARCC2 | NM_003075 | 2205 TACCGACTGAACCCCCAA | 2206 GACATCACCCGCTAGGTTTC | 2207 TATCTTACCTCTACC GCCTGCCGC | 2208 TACCGACTGAACCCCAAGAGTATCTTACCT CTACCGCCTGCCGCCGAAACCTAGCGGGTGA TGTC |
| SMARCD1 | NM_003076 | 2209 CCGAGTTAGCATATCCCAGG | 2210 CCTTTGTGCCCAGCTGTC | 2211 CCCACCCTTGCTGTG TTGAGTCTG | 2212 CCGAGTTAGCATATCCCAGGCTCGCAGACTC AACACAGCAAGGGTGGGAGCAGCTGGGCAC AAAGG |

TABLE A-continued

| Official Symbol: | Accession Number: | SEQ ID NO Forward Primer Sequence: | | SEQ ID NO Reverse Primer Sequence: | | SEQ ID NO Probe Sequence: | | SEQ ID NO Amplicon Sequence: | |
|---|---|---|---|---|---|---|---|---|---|
| SMO | NM_005631 | 2213 | GGCATCCAGTGCC | 2214 | CGCGATGTAGCTGTG | 2215 | CTTCACAGAGGCTGAGCACC | 2216 | GGCATCCAGTGCCAGAACCCGCTCTTCACAGAGGCT |
| SNAI1 | NM_005985 | 2217 | CCCAATCGAAGC | 2218 | GTAGGGCTGCTGGAA | 2219 | TCTGGATTAGAGTCCTGCAG | 2220 | CCCAATCGAAGCTAACTACAGCGAGCTGCAGGAC |
| SNRPB2 | NM_003092 | 2221 | CGTTTCCTGCTTTT | 2222 | AGGTAGAAGGCGCAC | 2223 | CCCACCTAAGGCCTACGCCG | 2224 | CGTTTCCTGCTTTTGGTTCTTACAGTAGTCGGCGTAG |
| SOD1 | NM_000454 | 2225 | TGAAGAGAGGCAT | 2226 | AATAGACACATCGGC | 2227 | TTTGTCAGCAGTCACATTGC | 2228 | TGAAGAGAGGCATGTTGGAGACTTGGGCAATGTGAC |
| SORBS1 | NM_015385 | 2229 | GCAGATGAGTGGA | 2230 | AGCGAGTGAAGAGGG | 2231 | ATTTCCATTGGCATCAGCAC | 2232 | GCAGATGAGTGGAGGCTTTCTTCCAGTGCTGATGCC |
| SOX4 | NM_003107 | 2233 | AGATGATCTCGGG | 2234 | GCGCCCTTCAGTAGG | 2235 | CGAGTCCAGCAGCATCTCCAACC | 2236 | AGATGATCTCGGAGAGACTGGCTCGAGTCCAGCATCT |
| SPARC | NM_003118 | 2237 | TCTTTCCCTGTACACTGGCAGTTC | 2238 | AGCTCGGTGTGGGAGAGGTA | 2239 | TGGACCAGCACCCCATTGACGG | 2240 | TCTTTCCCTGTACACTGGCAGTTCGGCCAGCTGGACCAGCACCCCATTGACGGGTACCTCTCCACACCGAGCT |
| SPARCL | NM_004684 | 2241 | GGCACAGTGCAAG | 2242 | GATTGAGCTCTCTG | 2243 | ACTTCATCCCAAGCCAGGCC | 2244 | GGCACAGTGCAAGTGATGACTATTCATCCCAAGCC |
| SPDEF | NM_012391 | 2245 | CCATCCGCCAGTATTACAAG | 2246 | GGGTGCACGAACTGGTAGA | 2247 | ATCATCCGGAAGCCAGACATCTCC | 2248 | CCATCCGCCAGTATTACAAGAAGGGCATCATCCGGAAGCCAGACATCTCCCAGCGCCTCGTCTACCAGTTCGT |
| SPINK1 | NM_003122 | 2249 | CTGCCATATGACC | 2250 | GTTGAAAACTGCACC | 2251 | ACCACGTCTCTTCAGAAGCC | 2252 | CTGCCATATGACCCTTCCAGTCCCAGGCTTCTGAAGA |
| SPINT1 | NM_003710 | 2253 | ATTCCCAGCACAG | 2254 | AGATGGCTACCACCA | 2255 | CTGTCCAGTGTTCCTGGTC | 2256 | ATTCCCAGCACAGGCTCTGTGGAGATGGCTCGCA |
| SPP1 | NM_001040058 | 2257 | TCACACATGGAAAGCGAGG | 2258 | GTTCAGGTCCTGGGCAAC | 2259 | TGAATGGTGCATACAAGGCCATCC | 2260 | TCACACATGGAAAGCGAGGAGTTGAATGGTGCATACAAGGCCATCCCCGTTGCCCAGGACCTGAAC |
| SQLE | NM_003129 | 2261 | ATTTTCGAGGCCAAAAATC | 2262 | CCTGAGCAAGGATATTCACG | 2263 | TGGGCAAGAAAAACATCTCATTCCTTTG | 2264 | ATTTTCGAGGCCAAAAATCATTTTACTGGGCAAGAAAAACATCATCCTTTGTGTGAATATCCTTGCTC |
| SRC | NM_005417 | 2265 | TGAGGAGTGGTATTTTGGCAAGA | 2266 | CTCTCGGGTCTCTGCATTGA | 2267 | AACCGCTCTGACTCCCGTCTGTG | 2268 | TGAGGAGTGGTATTTTGGCAAGATCACCAGACGGGAGTCAGAGCCGGTTACTGCTCAATGCAGAGAACCCGAG |
| SRD5A1 | NM_001047 | 2269 | GGGCTGGAATCTG | 2270 | CCATGACTGCACAAT | 2271 | CCTCTCTCGGAGGCCACAGA | 2272 | GGGCTGGAATCTGTCTAGGAGCCCTCTCTCGGAGGC |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| SRD5A2 | NM_000348 | 2273 GTAGGTCTTCCTGGCGTTCTG | 2274 TCCCTGGAAGGGTAGGAGTAA | 2275 AGACACCACTCAGAA TCCCCAGGC | 2276 GTAGGTCTTCCTGCCGTTCTGCCAGCTGCCT GGGGATTTGAGTGGTGTCTGCTTAGAGTTT ACTCCTACCCTT |
| ST5 | NM_005418 | 2277 CCTGTCCTGCCAG | 2278 CAGCTGCACAAAACT | 2279 AGTCACGAGACACCCA GCGA | 2280 CCTGTCCTGCCAGAGCATGGATGAAGTTTCG CTGGGT |
| STAT1 | NM_007315 | 2281 GGGCTCAGCTTTCAGAAGTG | 2282 ACATGTTCAGCTGGTCCACA | 2283 TGGCAGTTTTCTTCT GTCACCAAAA | 2284 GGGCTCAGCTTTCAGAAGTGCTGAGTTGCA GTTTTCTTCTGTCACCAAAAGAGAGTCTCAAT GTGGACCAGCT |
| STAT3 | NM_003150 | 2285 TCACATGCCACTTT | 2286 CTTGCAGGAAGCGGC | 2287 TCCTGGGAGAGATTG ACCAG | 2288 TCACATGCCACTTTGGTGTTTCATAATCTCC TGGGAG |
| STAT5A | NM_003152 | 2289 GAGGCGCTCAACATGAAATTC | 2290 GCCAGGAACACGAGGTTCTC | 2291 CGGTTGCTCTGCACT TCGGCCT | 2292 GAGGCGCTCAACATGAAATTCAAGGCCGAAG TGCAGAGCAACCGGGGCCTGACCAAGGAGAA CCTCGTGTTC |
| STAT5B | NM_012448 | 2293 CCAGTGGTGGTGA | 2294 GCAAAAGCATTGTCC | 2295 CAGCCAGGACAACAA TGCG | 2296 CCAGTGGTGGTGATCGTTCATGGCAGCCAGG ACAAC |
| STMN1 | NM_005563 | 2297 AATACCCAACGCA | 2298 GGAGACAATGCAAAC | 2299 CACGTTCTCTGCCCC GTTTC | 2300 AATACCCAACGCACAAATGACCCGCACGTTCT CTGCC |
| STS | NM_000351 | 2301 GAAGATCCCTTTCCTCCTACTGTT C | 2302 GGATGATGTTCGGCCTTGAT | 2303 CTGCGTTGGCTCTCGG CTTCCCA | 2304 GAAGATCCCTTTCCTCCTACTGTTCTTTCTGT GGGAAGCCGAGAGCCACGCAGCATCAAGGCCG AACATCATC |
| SULF1 | NM_015170 | 2305 TGCAGTTGTAGGGAGTCTGG | 2306 TCTCAAGAATTGCCGTTGAC | 2307 TACCGTGCCAGCAGA AGCCAAAG | 2308 TGCAGTTGTAGGGAGTCTGGTTACCGTGCCAG CAGAAGCCAAAGAAGAAGAGTCAACGGCAATTCT TGAGA |
| SUMO1 | NM_003352 | 2309 GTGAAGCCACCGT | 2310 CCCTTCCTTCTTATCC | 2311 CTGACCAGGAGGCAA AACCT | 2312 GTGAAGCCACCGTCATCATGTCTGACCAGGA GGCAA |
| SVIL | NM_003174 | 2313 ACTTGCCCAGCAC | 2314 GACACCATCCGTGTC | 2315 ACCCCAGGACTGATG TCAAG | 2316 ACTTGCCCAGCACACAAGGAGAAGACCCCAGGACT GATGT |
| TAF2 | NM_003184 | 2317 GCGCTCCACTCTCAGTCTTT | 2318 CTTGTGCTCATGGTGATGGT | 2319 AGCCTCCAAACACAG TGACCACCA | 2320 GCGCTCCACTCTCAGTCTTTACTAAGGAATC TACAGCCTCCAAACACAGTGACCACCACCAC CACCATCACCAT |
| TARP | NM_001003799 | 2321 GAGCAACACGATTCTGGGA | 2322 GGCACCGTTAACCAGCTAAAT | 2323 TCTTTCATGGTGTTCC CCTCCTGG | 2324 GAGCAACACGATTCTGGGATCCAGGAGGGG AACACCATGAAGACTAACGACACATACATGA AATTTAGCTG |
| TBP | NM_003194 | 2325 GCCCGAAACGCCG | 2326 CGTGGCTCTCTTATCC | 2327 TACCGCAGCAAACCG CTTGG | 2328 GCCCGAAACGCCGAATATAATCCCAAGCGGT TTGCT |

TABLE A-continued

| Official Symbol: | Accession Number: | SEQ ID NO | Forward Primer Sequence: | SEQ ID NO | Reverse Primer Sequence: | SEQ ID NO | Probe Sequence: | SEQ ID NO | Amplicon Sequence: |
|---|---|---|---|---|---|---|---|---|---|
| TFDP1 | NM_007111 | 2329 | TGCGAAGTGCTTTTGTTTGT | 2330 | GCCTTCCAGACAGTCTCCAT | 2331 | CGCACCAGCATGGCA ATAAGCTTT | 2332 | TGGCGAAGTGCTTTTGTTTGTTTGTTTTCGTT TGGTTAAAGCTTATTGCCATGCTGGTGCGGC TATGGAGACTGTC |
| TFF1 | NM_003225 | 2333 | GCCCTCCCAGTGTGCAAAT | 2334 | CGTCGATGGTATTAGGATAGAAGC A | 2335 | TGCTGTTTCGACGAC ACCGTCG | 2336 | GCCCTCCCAGTGTGCAAATAAGGGCTGTGT TTCGACGACACCGTTCGTGGGGTCCCCTGGT GCTTCTATCCTA |
| TFF3 | NM_003226 | 2337 | AGGCACTGTTCATCTCAGTTTTTC T | 2338 | CATCAGGCTCCAGATATGAACTTT C | 2339 | CAGAAGCGCTTGCCG GGAGCAAAGG | 2340 | AGGCACTGTTCATCTCAGCTTTTCTGTCCCT TTGCTCCCGGCAAGCGCTTCTGCTGAAAGTT CATATCTGGAG |
| TGFA | NM_003236 | 2341 | GGTGTGCCACAGACCTTCCT | 2342 | ACGGAGTTCTTGACAGAGTTTTGA | 2343 | TTGGCCTGTAATCAC CGTGCAGCCTT | 2344 | GGTGTGCCACAGACCTTCACTTCGGCCTGTA ATCACCGTGCAGCCTTTTGTGGGCCTTCAA AACTCTGTCAA |
| TGFB1I1 | NM_001042454 | 2345 | GCTACTTTGAGCGCCTTCTCG | 2346 | GGTCACCATCTTGTGTCGG | 2347 | CAAGATGTGGCTTCT GCAACCAGC | 2348 | GCTACTTTGAGCGCCTTCTCGCCAAGATGTGG CTTCTGCAACCAGCCACCATCCGACACAAGATG GTGACC |
| TGFB2 | NM_003238 | 2349 | ACCAGTCCCCCAG | 2350 | CCTGGTGCTGTTGTA | 2351 | TCCTGAGCCCCGAGGA AGTCC | 2352 | ACCAGTCCCCCAGGAGACTATCCTGAGCCCG AGGAA |
| TGFB3 | NM_003239 | 2353 | GGATCGAGCTCTT | 2354 | GCCACCGATATAGCG | 2355 | CGGCCAGATGAGCAC ATTGC | 2356 | GGATCGAGCTCTTCCAGATCCTTCGGCCAGA TGAGC |
| TGFBR2 | NM_003242 | 2357 | AACACCAATGGGT | 2358 | CCCTCTTCATCAGGCC | 2359 | TTCTGGGCTCCTGAT TGCTC | 2360 | AACACCAATGGGTTCCATCTTTCTGGGCTCC TGATTG |
| THBS2 | NM_003247 | 2361 | CAAGACTGGCTACATCAGAGTCTT AG | 2362 | CAGCGTAGGTTTGGTCATAGATAG G | 2363 | TGAGTCTGCCATGAC CTGTTTTCCTTCAT | 2364 | CAAGACTGGCTACATCAGAGTCTTTAGTGCAT GAAGGAAAACAGGTCATGGCAGACTCAGGAC CTATCTATGA |
| THY1 | NM_006288 | 2365 | GGACAAGACCCTC | 2366 | TTGGAGGCTGTGGGT | 2367 | CAAGCTCCCAAGAGC TTCCA | 2368 | GGACAAGACCCTCTTCTCAGGCTGTCCCAAGCTC CCAAG |
| TIAM1 | NM_003253 | 2369 | GTCCCTGGCTGAA | 2370 | GGGCTCCCGAAGTCT | 2371 | TGGAGCCCTTCTCCC AAGAT | 2372 | GTCCCTGGCTGAAAATGGCCTGAGCCCCTTC TCCCAA |
| TIMP2 | NM_003255 | 2373 | TCACCCCTCTGTGA | 2374 | TGTGGTTCAGGCTCTT | 2375 | CCCTGGGACACCCTG AGCAC | 2376 | TCACCCCTCTGTGACTTTCATCGTGCCCTGGA CACCCT |
| TIMP3 | NM_000362 | 2377 | CTACCTGCCTTGCT | 2378 | ACCGAAATTGGAGAG | 2379 | CCAAGAACGAGTGTC TCTGG | 2380 | CTACCTGCCTTGCTTTGTGACTTCCAAGAAC GAGTGT |
| TK1 | NM_003258 | 2381 | GCCGGGAAGACCGTAATTGT | 2382 | CAGCGGCACCAGGTTCAG | 2383 | CAAATGGCTTCCTCT GGAAGGTCCCA | 2384 | GCCGGGAAGACCGTAATTGTGGCTGCACTGG ATGGGACTTCCAGAGGAAGCCATTTGGGGC CATCCTGAAC |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| TMPRSS | NM_005656 | 2385 GGACAGTGTGCAC | 2386 CTCCCACGAGGAAGG | 2387 AAGCACTGTGCATCACCTTG | 2388 GGACAGTGTGCACCTCAAAGACTAAGAAAGCACTGT |
| TMPRSS2ERGA | DQ204772 | 2389 GAGGCGGAGGGCGAG | 2390 ACTGTCTCCACTCACAACT | 2391 TAAGGCTTCCTGCCGCGCTCCA | 2392 GAGGCGGAGGGCGAGGGCGGGAGCGCCTGGAGCGCGGCGCAGGAAGCCTTATCAGTTGTGAG |
| TMPRSS2ERGB | DQ204773 | 2393 GAGGCGGAGGGCGAG | 2394 TTCCTGGGTCTCCAAAGAT | 2395 CCTGGAATAACCTGCCGCGC | 2396 GAGGCGGAGGGCGAGGGCGGGAGGGCCGCCTGGAGCGCGGCGCAGGTTATTCCAGGATCTTTGGAGACCCG |
| TNF | NM_000594 | 2397 GGAGAAGGGTGAC | 2398 TGCCCAGACTCGGCA | 2399 CGCTGAGATCAATCGGCCCG | 2400 GGAGAAGGGTGACCGACTCAGCGCTGAGATCAATCG |
| TNFRSF10A | NM_003844 | 2401 TGCACAGAGGGGTGTGGGTTAC | 2402 TCTTCATCTGATTTACAAGCTGTACATG | 2403 CAATGCTTCCAACAATTTGTTGTTGCTGCC | 2404 TGCACAGAGGGGTGTGGGTTACACCAATGCTTCCAACAATTTGTTGCTTGCCTCCCATGTACAGCTTGTAAAT |
| TNFRSF10B | NM_003842 | 2405 CTCTGAGACAGTGCTTCGATGACT | 2406 CCATGAGGCCCAACTTCCT | 2407 CAGACTTGGTGCCCTTGACTCC | 2408 CTCTGAGACAGTGCTTCGATGACTTTGCAGACTTGGTGCCCTTGACTCCTGGGAGCCGCTCATGAGGAAGTT |
| TNFRSF18 | NM_148901 | 2409 CAGAAGCTGCCAGTTCCC | 2410 CACCCACAGTCTCCCAG | 2411 CCTTTCCTCTGCCGATCGCTC | 2412 CAGAAGCTGCCAGTTCCCCGAGGAAGAGCGGGGCAGCGATCGGCAGAGGAGAAGGGCGCTGGGAGACCT |
| TNFSF10 | NM_003810 | 2413 CTTCACAGTGCTC | 2414 CATCTGCTTCAGCTG | 2415 AAGTACACGTAAGTTACAGC | 2416 CTTCACAGTGCTCCTGCAGTCTCTCTGTGGCTGTA |
| TNFSF11 | NM_003701 | 2417 AACTGCATGTGGG | 2418 TGACACCCTCCCACT | 2419 ACATGACCAGGGACCAACCC | 2420 AACTGCATGTGGGCTATGGGAGGGTTGTCCCTGG |
| TOP2A | NM_001067 | 2421 AATCCAAGGGGGA | 2422 GTACAGATTTTGCCC | 2423 CATATGACTTTGACTCAGC | 2424 AATCCAAGGGGGAGTCATGACTTTGACTTCCATATGGACT |
| TP53 | NM_000546 | 2425 CTTTGAACCCCTTGC | 2426 CCCGGGACAAAGCAA | 2427 AAGTCCTGGGTCTTCTGAC | 2428 CTTTGAACCCCTTGCCTTTGCAATAGGTGTGCGTCAGAAG |
| TP63 | NM_003722 | 2429 CCCCAAGCAGTGC | 2430 GAATCGCACAGCATC | 2431 CCCGGGTCTCACTGGAGCCC | 2432 CCCCAAGCAGTGCCTTCTACAGTCAGTGTGGGCTCCA |
| TPD52 | NM_005079 | 2433 GCCTGTGAGATTC | 2434 ATGTGCTTGGACCTC | 2435 TCTGCTACCCACTGCCAGAT | 2436 GCCTGTGAGATTCCTACCTTTGTCTGCTACCCACTG |
| TPM1 | NM_001018005 | 2437 TCTCTGAGCTCTGCATTTGTC | 2438 GGCTCTAAGGCAGCAGGATGCTA | 2439 TTCTCCAGCTGACCCTGGTTCTC | 2440 TCTCTGAGCTCTGCATTTGTCTATTCTCCAGCTGACCCTGGTTCTCTCTTAGCATCCTGCCTTAGAGCC |
| TPM2 | NM_213674 | 2441 AGGAGATGCAGCT | 2442 CCACCTCTTCATATTT | 2443 CCAAGCACATCGCTGAGGAT | 2444 AGGAGATGCAGCTGAAGGAGGCCAAGCACATCGCTG |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| TPP2 | NM_003291 | 2445 TAACCGTGGCATC | 2446 ATGCCAACGCCATGA | 2447 ATCCTGTTCAGGTGG CTGCA | 2448 TAACCGTGGCATTACCTCCGAGATCCTGTT CAGGTG |
| TPX2 | NM_012112 | 2449 TCAGCTGTGAGCTGCGGATA | 2450 ACGGTCCTAGGTTTGAGGTTAAGA | 2451 CAGGTCCCATTGCCG GGCG | 2452 TCAGCTGTGAGCTGCGGATACCGCCCGGCAA TGGGACCTGCTCTTAACCTCAAACCTAGGAC CGT |
| TRA2A | NM_013293 | 2453 GCAAATCCAGATC | 2454 CTTCACGAAGATCCC | 2455 AACTGAGGCCAAACA CTCCA | 2456 GCAAATCCAGATCCCAACACTTGCCTGGAG TGTTTG |
| TRAF3IP | NM_147200 | 2457 CCTCACAGGAACC | 2458 CTGGGGCTGGGAATC | 2459 TGGATCTGCCAACCA TAGAC | 2460 CCTCACAGGAACCGAGCAGGCCTCGATCTGC CAACC |
| TRAM1 | NM_014294 | 2461 CAAGAAAAGCACC | 2462 ATGTCCGCTGATTCT | 2463 AGTGTCGAGCCACGA ATTCG | 2464 CAAGAAAAGCACCAAGAGCCCCCCAGTGCTG AGCCA |
| TRAP1 | NM_016292 | 2465 TTACCAGTGGCTTT | 2466 TGTCCCGGTTCTAACT | 2467 TTCGGCGATTTCAAA CACTC | 2468 TTACCAGTGGCTTTCAGATGGTTCTGGAGTG TTTGAA |
| TRIM14 | NM_033220 | 2469 CATTCGCCTTAAG | 2470 CAAGGTACCTGGCTT | 2471 AACTGCCAGCTCTCA GACCC | 2472 CATTCGCCTTAAGGAAAGCATAAACTGCCAG CTCTCA |
| TRO | NM_177556 | 2473 GCAACTGCCACCC | 2474 TGGTGTGGATACTGG | 2475 CCACCCAAGGCCAAA TTACC | 2476 GCAACTGCCACCCATACAGTAGTACCACCCAAG GCCAA |
| TRPC6 | NM_004621 | 2477 CGAGAGCCAGGACTATCTGC | 2478 TAGCCGTAGCAAGGCAGC | 2479 CTTCTCCCAGCTCCG AGTCCATG | 2480 CGAGAGCCAGGACTATCTGCTCATGGACTCG GAGCTGGGAGAAGACGGCTGCCCGCAAGCCC CGCTGCCTTG |
| TRPV6 | NM_018646 | 2481 CCGTAGTCCTGCGAACCTC | 2482 TCCTCACTGTTCACACAGGC | 2483 ACTTTGGGGAGCACC CTTTGTCCT | 2484 CCGTAGTCCTGCAACCTCATCTACTTTGGG GAGCACCCTTTGTCCTTTGCTGCCTGTGTGA ACAGTGAGGA |
| TSTA3 | NM_003313 | 2485 CAATTTGGACTTCT | 2486 CACCTCAAAGGCCGA | 2487 AACGTGCACATGAAC GACAA | 2488 CAATTTGGACTTCTGGAGAAAAACGTGCAC ATGAA |
| TUBB2A | NM_001069 | 2489 CGAGGACGAGGCT | 2490 ACCATGCTTGAGGAC | 2491 TCTCAGATCAATCGT GCATC | 2492 CGAGGACGAGGCTTAAAAACTTCTCAGATCA ATCGT |
| TYMP | NM_001953 | 2493 CTATATGCAGCCAGAGATGTGACA | 2494 CCACGAGTTTCTTACTGAGAATGG | 2495 ACAGCCTGCCACTCA TCACAGCC | 2496 CTATATGCAGCCAGAGATGTGACAGCCACCG TGGACAGCCTGCCACTCATCACAGCCTCCAT TCTCAGTAAGA |
| TYMS | NM_001071 | 2497 GCCTCGGTGTGCC | 2498 CGTGATGTGCGCAAT | 2499 CATCGCCAGCTACGC CCTGC | 2500 GCCTCGGTGTGCCTTTCAACATCGCCAGCTA CGCCCT |
| UAP1 | NM_003115 | 2501 CTGGAGAGCGGTCGTAGCTG | 2502 GCCAAGCTTTGTAGAAATAGGG | 2503 TACCTGTAAACCTTT CTCGGCGCG | 2504 CTGGAGAGCGGTCGTAGCTGCGGTCGCGCCGA GAAAGGTTTACAGTACATACATTACACCCC TATTTCTACAA |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| UBE2C | NM_007019 | 2505 TGTCTGGCGATAA | 2506 ATGGTCCCTACCCATT | 2507 TCTGCCTTCCCTGAATCAGA | 2508 TGTCTGGCGATAAAGGGATTTCTGCCTTCCCTGAATC |
| UBE2G1 | NM_003342 | 2509 TGACACTGAACGA | 2510 AAGCAGAGAGGAATC | 2511 TTGTCCACCAGTGCCTCAT | 2512 TGACACTGAACGAGGTGGCTTTTGTCCCACCAGTGCC |
| UBE2T | NM_014176 | 2513 TGTTCTCAAATTGC | 2514 AGAGGTCAACACAGT | 2515 AGGTGCTTGGAGACCATCCC | 2516 TGTTCTCAAATTGCCACCAAAAGTGCTTGGAGACC |
| UGDH | NM_003359 | 2517 GAAACTCCAGAGG | 2518 CTCTGGGAACCCAGT | 2519 TATACAGCACACAGGGCCTG | 2520 GAAACTCCAGAGGCCAGAGAGCTGTGCAGGCCCTG |
| UGT2B1 | NM_001076 | 2521 AAGCCTGAAGTGG | 2522 CCTCCATTTAAAACCC | 2523 AAAGATGGGACTCCTCCTTT | 2524 AAGCCTGAAGTGGAATGACTGAAAGATGGGACTCCT |
| UGT2B1 | NM_001077 | 2525 TTGAGTTTGTCATG | 2526 TCCAGGTGAGGTTGT | 2527 ACCCGAAGGTGCTTGGCTCC | 2528 TTGAGTTTGTCATGCCCATAAAGGAGCCAAGCACC |
| UHRF1 | NM_013282 | 2529 CTACAGGGGCAAA | 2530 GGTGTCATTCAGGCG | 2531 CGGCCATACCCTCTTCGACT | 2532 CTACAGGGGCAAACAGATGGAGGAGGCCATACCCT |
| UTP23 | NM_032334 | 2533 GATTGCACAAAAA | 2534 GGAAAGCAGACATTC | 2535 TCGAAATTGTCCTCATTTCA | 2536 GATTGCACAAAAATGCCAAGTTCGAAATTGTCCTCAT |
| VCAM1 | NM_001078 | 2537 TGGCTTCAGGAGCTGAATACC | 2538 TGCTGTCGTGATGAGAAAATAGTG | 2539 CAGGCACACAGGTGGGACACAAAT | 2540 TGGCTTCAGGAGCTGAATACCCTCCAGGCACACAGTGGGACACAAATAAGGGTTTTGGAACCACTATT |
| VCL | NM_003373 | 2541 GATACCACAACTCCCATCAAGCT | 2542 TCCCTGTTAGGCGCATCAG | 2543 AGTGGCAGCCACGGCGCC | 2544 GATACCACAACTCCCATCAAGCTGTTGGCAGTGGCAGCCACGGCCGCCTCCTGATGCGCCTAACAGGGA |
| VCPIP1 | NM_250054 | 2545 TTTCTCCCAGTACC | 2546 TGAATAGGGAGCCTT | 2547 TGGTCCATCCTCTGCACCTG | 2548 TTTCTCCCAGTACCATTCGTGATGGTCCATCCTCTGC |

TABLE A-continued

| Official Symbol: | Accession Number: | SEQ ID NO | Forward Primer Sequence: | SEQ ID NO | Reverse Primer Sequence: | SEQ ID NO | Probe Sequence: | SEQ ID NO | Amplicon Sequence: |
|---|---|---|---|---|---|---|---|---|---|
| VDR | NM_000376 | 2549 | CCTCTCCTTCCAGC | 2550 | TCATTGCCAAACACTT | 2551 | CAGCATGAAGCTAAC GCCCC | 2552 | CCTCTCCTTCCAGCCTGAGTGCAGCCATGAAG CTAACG |
| VEGFA | NM_003376 | 2553 | CTGCTGTCTTGGG | 2554 | GCAGCCTGGGACCAC | 2555 | TTGCCTTGCTGCTCT ACCTC | 2556 | CTGCTGTCTTGGGTGCATTGGAGCCTTGCCT TGCTGC |
| VEGFB | NM_003377 | 2557 | TGACGATGGCCTG | 2558 | GGTACCGGATCATGA | 2559 | CTGGGCAGCAGCCAAAG TCCGG | 2560 | TGACGATGGCCTGAGTGTGTGCCCACTGGG CAGCA |
| VEGFC | NM_005429 | 2561 | CCTCAGCAAGACGTTATTTGAAAT T | 2562 | AAGTGTGATTGGCAAAACTGATTG | 2563 | CCTCTCTCTCAAGGC CCCAAACCAGT | 2564 | CCTCAGCAAGACGTTATTTGAAATTACAGTG CCTCTCTCTCAAGGCCCCAAACCAGTAACAA TCAGTTTTGCCA |
| VIM | NM_003380 | 2565 | TGCCCCTTAAAGGA | 2566 | GCTTCAACGGCAAAG | 2567 | ATTTCACGCATCTGG CGTTC | 2568 | TGCCTTAAAGGAACCAATGAGTCCCTGAAC GCCA |
| VTI1B | NM_006370 | 2569 | ACGTTATGCACCCCTGTCTT | 2570 | CCGATGGAGTTTAGCAAGGT | 2571 | CGAAACCCCATGATG TCTAAGCTTCG | 2572 | ACGTTATGCACCCCTGTCTTTCCGAAACCCC ATGATGTCTAAGCTTCGAAACTACCGGAAGG ACCTTGCTAAA |
| WDR19 | NM_025132 | 2573 | GAGTGGCCCAGAT | 2574 | GATGCTTGAGGGCTT | 2575 | CCCCTCGACGTATGT CTCCC | 2576 | GAGTGGCCCAGATGTCCATAAGAATGGGAGA CATAC |
| WFDC1 | NM_021197 | 2577 | ACCCCTGCTCTGT | 2578 | ATACCTTCGGCCACG | 2579 | CTATGAGTGCCACAT CCTGA | 2580 | ACCCCTGCTCTGTCCCTCGGGCTATGAGTGC CACATC |
| WISP1 | NM_003882 | 2581 | AGAGGCATCCATGAACTTCACA | 2582 | CAAACTCCACAGTACTTGGGTTGA | 2583 | CGGGCTGCATCAGCA CACGC | 2584 | AGAGGCATCCATGAACTTCACATTGCGGGC TGCATCAGCACACGCTCCTATCAACCCAAGT ACTGTGGAGTT |
| WNT5A | NM_003392 | 2585 | GTATCAGGACCACATGCAGTACAT C | 2586 | TGTCGGAATTGATACTGGCATT | 2587 | TTGATGCCTGTTCTTC GCGCCTTCT | 2588 | GTATCAGGACCACATGCAGTACATCGGAGAA GGCGGAAGACAGGCATCAAAGAATGCCAGT ATCAATTCCG |

TABLE A-continued

| Official Symbol: | Accession Number: | SEQ ID NO Forward Primer Sequence: | SEQ ID NO Reverse Primer Sequence: | SEQ ID NO Probe Sequence: | SEQ ID NO Amplicon Sequence: |
|---|---|---|---|---|---|
| WWOX | NM_016373 | 2589 ATCGCAGCTGGTG | 2590 AGCTCCCTGTTGCAT | 2591 CTGCTGTTTACCTTG GCGAG | 2592 ATCGCAGCTGGTGGGTGTACACACTGCTGTT TACCTT |
| XIAP | NM_001167 | 2593 GCAGTTGGAAGACACAGGAAAGT | 2594 TGCGTGGCACTATTTTCAAGA | 2595 TCCCCAAATTGCAGA TTTATCAACGGC | 2596 GCAGTTGGAAGACACAGGAAAGTATCCCCAA ATTGCAGATTTATCAACGGCTTTTATCTTGA AAATAGTGCCA |
| XRCC5 | NM_021141 | 2597 AGCCCACTTCAGC | 2598 AGCAGGATTCACACT | 2599 TCTGGCTGAAGGCAG TGTCA | 2600 AGCCCACTTCAGCTCTCCAGTCTGGCTGAA GGCAG |
| YY1 | NM_003403 | 2601 ACCCGGGCAACAA | 2602 GACCGAGAACTCGCC | 2603 TTGATCTGCACCTGC TTCTG | 2604 ACCCGGGCAACAAGAAGTGGGAGCAGAAGCA GGTGC |
| ZFHX3 | NM_006885 | 2605 CTGTGGAGCCTCT | 2606 GGAGCAGGGTTGGAT | 2607 ACCTGGCCCAACTCT ACCAG | 2608 CTGTGGAGCCTCTGCCTGCGGACCTGGCCCA ACTCTA |
| ZFP36 | NM_003407 | 2609 CATTAACCCACTC | 2610 CCCCCACCATCATGA | 2611 CAGGTCCCCAAGTGT GCAAG | 2612 CATTAACCACTCCCCTGACCTCACGCTGGG GCAGGT |
| ZMYND8 | NM_183047 | 2613 GGTCTGGGCCAAA | 2614 TGCCCGTCTTTATCCC | 2615 CTTTTGCAGGCCAGA ATGGA | 2616 GGTCTGGGCCAAACTGAAGGGGTTTCCATTC TGGCCT |
| ZNF3 | NM_017715 | 2617 CGAAGGGACTCTG | 2618 GCAGAGAGGTCCTCAG | 2619 AGGAGGTTCCACACT CGCCA | 2620 CGAAGGGACTCTGCTCCAGTGAACTGGCGAG TGTGG |
| ZNF827 | NM_178835 | 2621 TGCCTGAGGACCC | 2622 GAGGTGGCGGAGTGA | 2623 CCCGCCTTCAGAGAA GAAAC | 2624 TGCCTGAGGACCCTCTACCGCCCCGCCTTC AGAGA |
| ZWINT | NM_007057 | 2625 TAGAGGGCCATCAA | 2626 TCCGTTTCCTCTGGGC | 2627 ACCAAGGCCCTGACT CAGAT | 2628 TAGAGGCCATCAAAATTGGCCTCACCAAGGC CCTGA |

TABLE B

| microRNA | Sequence | SEQ ID NO |
|---|---|---|
| hsa-miR-1 | UGGAAUGUAAAGAAGUAUGUAU | 2629 |
| hsa-miR-103 | GCAGCAUUGUACAGGGCUAUGA | 2630 |
| hsa-miR-106b | UAAAGUGCUGACAGUGCAGAU | 2631 |
| hsa-miR-10a | UACCCUGUAGAUCCGAAUUUGUG | 2632 |
| hsa-miR-133a | UUUGGUCCCCUUCAACCAGCUG | 2633 |
| hsa-miR-141 | UAACACUGUCUGGUAAAGAUGG | 2634 |
| hsa-miR-145 | GUCCAGUUUUCCCAGGAAUCCCU | 2635 |
| hsa-miR-146b-5p | UGAGAACUGAAUUCCAUAGGCU | 2636 |
| hsa-miR-150 | UCUCCCAACCCUUGUACCAGUG | 2637 |
| hsa-miR-152 | UCAGUGCAUGACAGAACUUGG | 2638 |
| hsa-miR-155 | UUAAUGCUAAUCGUGAUAGGGGU | 2639 |
| hsa-miR-182 | UUUGGCAAUGGUAGAACUCACACU | 2640 |
| hsa-miR-191 | CAACGGAAUCCCAAAAGCAGCUG | 2641 |
| hsa-miR-19b | UGUAAACAUCCUCGACUGGAAG | 2642 |
| hsa-miR-200c | UAAUACUGCCGGGUAAUGAUGGA | 2643 |
| hsa-miR-205 | UCCUUCAUUCCACCGGAGUCUG | 2644 |
| hsa-miR-206 | UGGAAUGUAAGGAAGUGUGUGG | 2645 |
| hsa-miR-21 | UAGCUUAUCAGACUGAUGUUGA | 2646 |
| hsa-miR-210 | CUGUGCGUGUGACAGCGGCUGA | 2647 |
| hsa-miR-22 | AAGCUGCCAGUUGAAGAACUGU | 2648 |
| hsa-miR-222 | AGCUACAUCUGGCUACUGGGU | 2649 |
| hsa-miR-26a | UUCAAGUAAUCCAGGAUAGGCU | 2650 |
| hsa-miR-27a | UUCACAGUGGCUAAGUUCCGC | 2651 |
| hsa-miR-27b | UUCACAGUGGCUAAGUUCUGC | 2652 |
| hsa-miR-29b | UAGCACCAUUUGAAAUCAGUGUU | 2653 |
| hsa-miR-30a | CUUUCAGUCGGAUGUUUGCAGC | 2654 |
| hsa-miR-30e-5p | CUUUCAGUCGGAUGUUUACAGC | 2655 |
| hsa-miR-31 | AGGCAAGAUGCUGGCAUAGCU | 2656 |
| hsa-miR-331 | GCCCCUGGGCCUAUCCUAGAA | 2657 |
| hsa-miR-425 | AAUGACACGAUCACUCCCGUUGA | 2658 |
| hsa-miR-449a | UGGCAGUGUAUUGUUAGCUGGU | 2659 |
| hsa-miR-486-5p | UCCUGUACUGAGCUGCCCCGAG | 2660 |
| hsa-miR-92a | UAUUGCACUUGUCCCGGCCUGU | 2661 |
| hsa-miR-93 | CAAAGUGCUGUUCGUGCAGGUAG | 2662 |
| hsa-miR-99a | AACCCGUAGAUCCGAUCUUGUG | 2663 |

SEQUENCE LISTING (2663 sequences)

SEQ ID NO: 1 - DNA, 20 bp, Artificial Sequence
  Synthetic oligonucleotide
gtgtggcaggtggacactaa

SEQ ID NO: 2 - DNA, 20 bp, Artificial Sequence
  Synthetic oligonucleotide
ctccatccactccaggtctc

SEQ ID NO: 3 - DNA, 24 bp, Artificial Sequence
  Synthetic oligonucleotide
cgcttcaaaggaccagacctcctc

SEQ ID NO: 4 - DNA, 66 bp, Artificial Sequence
  Synthetic oligonucleotide
gtgtggcaggtggacactaaggaggaggtctggtcctttgaagcgggagacctggagtggatggag

SEQ ID NO: 5 - DNA, 19 bp, Artificial Sequence
  Synthetic oligonucleotide
ggtatggatcccaaagcca

SEQ ID NO: 6 - DNA, 20 bp, Artificial Sequence
  Synthetic oligonucleotide
cagcccgctttctgttttta

SEQ ID NO: 7 - DNA, 24 bp, Artificial Sequence
  Synthetic oligonucleotide
cacatgtggcgagcaattcgaact

SEQ ID NO: 8 - DNA, 73 bp, Artificial Sequence
  Synthetic oligonucleotide
ggtatggatcccaaagccaaacagcacatgtggcgagcaattcgaactgcatttaaaaacagaaagcgggctg

SEQ ID NO: 9 - DNA, 20 bp, Artificial Sequence
  Synthetic oligonucleotide
aaacaccactggagcattga

SEQ ID NO: 10 - DNA, 20 bp, Artificial Sequence
  Synthetic oligonucleotide
caagcctggaacctatagcc

SEQ ID NO: 11 - DNA, 20 bp, Artificial Sequence
  Synthetic oligonucleotide
caagcctggaacctatagcc

SEQ ID NO: 12 - DNA, 77 bp, Artificial Sequence
  Synthetic oligonucleotide
aaacaccactggagcattgactaccaggctcgccaatgatgctgctcaagttaaaggggctataggttccaggcttg

SEQ ID NO: 13 - DNA, 18 bp, Artificial Sequence
  Synthetic oligonucleotide
tcatggtgcccgtcaatg

SEQ ID NO: 14 - DNA, 23 bp, Artificial Sequence
  Synthetic oligonucleotide
cgattgtctttgctcttcatgtg

SEQ ID NO: 15 - DNA, 29 bp, Artificial Sequence
  Synthetic oligonucleotide
acctgatacgtcttggtcttcatcgccat

SEQ ID NO: 16 - DNA, 79 bp, Artificial Sequence
  Synthetic oligonucleotide
tcatggtgcccgtcaatgctgtgatggcgatgaagaccaagacgtatcaggtggcccacatgaagagcaaagacaatcg

SEQ ID NO: 17 - DNA, 22 bp, Artificial Sequence
  Synthetic oligonucleotide
tcatcctggcgatctacttcct

SEQ ID NO: 18 - DNA, 20 bp, Artificial Sequence
  Synthetic oligonucleotide
ccgttgagtggaatcagcaa

SEQ ID NO: 19 - DNA, 26 bp, Artificial Sequence
  Synthetic oligonucleotide
tctgtcctggctggagtcgctttcat

SEQ ID NO: 20 - DNA, 91 bp, Artificial Sequence
  Synthetic oligonucleotide
tcatcctggcgatctacttcctctggcagaacctaggtccctctgtcctggctggagtcgctttcatggtcttgctgattccactcaacgg

SEQ ID NO: 21 - DNA, 20 bp, Artificial Sequence
  Synthetic oligonucleotide
agcgcctggaatctacaact

SEQ ID NO: 22 - DNA, 20 bp, Artificial Sequence
  Synthetic oligonucleotide
agagcccctggagagaagat

SEQ ID NO: 23 - DNA, 24 bp, Artificial Sequence
  Synthetic oligonucleotide
cggagtccagtgttttcccactta

SEQ ID NO: 24 - DNA, 66 bp, Artificial Sequence
  Synthetic oligonucleotide
agcgcctggaatctacaactcggagtccagtgttttcccacttatcatcttctctccaggggctct

SEQ ID NO: 25 - DNA, 20 bp, Artificial Sequence
  Synthetic oligonucleotide
cgtctgtcactgtggagtgg

SEQ ID NO: 26 - DNA, 18 bp, Artificial Sequence
  Synthetic oligonucleotide
tgatccggtttagcaggc

SEQ ID NO: 27 - DNA, 24 bp, Artificial Sequence
  Synthetic oligonucleotide
agtctcttggccaccttcagccct

SEQ ID NO: 28 - DNA, 72 bp, Artificial Sequence
  Synthetic oligonucleotide
cgtctgtcactgtggagtggacagggctgaaggtggccaagagactgcaccgcagcctgctaaaccggatca

SEQ ID NO: 29 - DNA, 18 bp, Artificial Sequence
  Synthetic oligonucleotide
ggtctcaacgccatcctg

SEQ ID NO: 30 - DNA, 20 bp, Artificial Sequence
  Synthetic oligonucleotide
cttggatctttccttgcagc

SEQ ID NO: 31 - DNA, 24 bp, Artificial Sequence
  Synthetic oligonucleotide
acgaagatttgcctccacctgtgg

SEQ ID NO: 32 - DNA, 80 bp, Artificial Sequence
  Synthetic oligonucleotide
ggtctcaacgccatcctgggacccacaggtggaggcaaatcttcgttattagatgtcttagctgcaaggaaagatccaag

SEQ ID NO: 33 - DNA, 21 bp, Artificial Sequence
  Synthetic oligonucleotide
gtagtgggtctgcatggatgt

SEQ ID NO: 34 - DNA, 18 bp, Artificial Sequence
  Synthetic oligonucleotide
tgagggttggcactcagg

SEQ ID NO: 35 - DNA, 23 bp, Artificial Sequence
  Synthetic oligonucleotide
caggtggctcctttgatccctga

SEQ ID NO: 36 - DNA, 67 bp, Artificial Sequence
  Synthetic oligonucleotide
gtagtgggtctgcatggatgtttcagggatcaaaggagccacctgggcgcctgagtgccaaccctca

SEQ ID NO: 37 - DNA, 19 bp, Artificial Sequence
  Synthetic oligonucleotide
ccgctgtacgaggatttca

SEQ ID NO: 38 - DNA, 18 bp, Artificial Sequence
  Synthetic oligonucleotide
ccgtgtctgtgaagccgt

SEQ ID NO: 39 - DNA, 24 bp, Artificial Sequence
  Synthetic oligonucleotide
tgccctcagcaatgaagcctacaa

SEQ ID NO: 40 - DNA, 67 bp, Artificial Sequence
  Synthetic oligonucleotide
ccgctgtacgaggatttcactgccctcagcaatgaagcctacaagcaggacggcttcacagacacgg

SEQ ID NO: 41 - DNA, 19 bp, Artificial Sequence
  Synthetic oligonucleotide
atggaggtgcccagaacac

SEQ ID NO: 42 - DNA, 20 bp, Artificial Sequence
  Synthetic oligonucleotide
actccgggtaactgtggatg

SEQ ID NO: 43 - DNA, 24 bp, Artificial Sequence
  Synthetic oligonucleotide
tgctctcaactttcctgcggagtg

SEQ ID NO: 44 - DNA, 66 bp, Artificial Sequence
  Synthetic oligonucleotide
atggaggtgcccagaacactgcactccgcaggaaagttgagagcatcatccacagttacccggagt

SEQ ID NO: 45 - DNA, 18 bp, Artificial Sequence
  Synthetic oligonucleotide
atccgcattgaagaccca

SEQ ID NO: 46 - DNA, 20 bp, Artificial Sequence
  Synthetic oligonucleotide
atccgctagaactgcaccac

SEQ ID NO: 47 - DNA, 24 bp, Artificial Sequence
  Synthetic oligonucleotide
cccgcagaaagcacatggtattcc

SEQ ID NO: 48 - DNA, 66 bp, Artificial Sequence
  Synthetic oligonucleotide
atccgcattgaagacccaccccgcagaaagcacatggtattcctgggtggtgcagttctagcggat

SEQ ID NO: 49 - DNA, 18 bp, Artificial Sequence
  Synthetic oligonucleotide
ggcgggatgtggtaacag

SEQ ID NO: 50 - DNA, 18 bp, Artificial Sequence
  Synthetic oligonucleotide
atttctgggcctccgagt

SEQ ID NO: 51 - DNA, 24 bp, Artificial Sequence
  Synthetic oligonucleotide
tcagccacaatcaccaactccaca

SEQ ID NO: 52 - DNA, 72 bp, Artificial Sequence
  Synthetic oligonucleotide
ggcgggatgtggtaacagagaccaagactgtggagttggtgattgtggctgatcactcggaggcccagaaat

SEQ ID NO: 53 - DNA, 21 bp, Artificial Sequence
  Synthetic oligonucleotide
ggacaggtgcaagctcatctg

SEQ ID NO: 54 - DNA, 21 bp, Artificial Sequence
  Synthetic oligonucleotide
atctacaaccttgggctgcaa

SEQ ID NO: 55 - DNA, 28 bp, Artificial Sequence
  Synthetic oligonucleotide
caagccaaaggcattggctacttcttcg

SEQ ID NO: 56 - DNA, 73 bp, Artificial Sequence
  Synthetic oligonucleotide
ggacaggtgcaagctcatctgccaagccaaaggcattggctacttcttcgttttgcagcccaaggttgtagat

SEQ ID NO: 57 - DNA, 20 bp, Artificial Sequence
  Synthetic oligonucleotide
atgctgtcatcattgtcacg

SEQ ID NO: 58 - DNA, 19 bp, Artificial Sequence
  Synthetic oligonucleotide
ctgcttcctttccctttcc

SEQ ID NO: 59 - DNA, 27 bp, Artificial Sequence
  Synthetic oligonucleotide
tgtctgcccattatcttcattctgcaa

SEQ ID NO: 60 - DNA, 70 bp, Artificial Sequence
  Synthetic oligonucleotide
atgctgtcatcattgtcacggtttgtctgcccattatcttcattctgcaagggaaagggaaaggaagcag

SEQ ID NO: 61 - DNA, 21 bp, Artificial Sequence
  Synthetic oligonucleotide
gatgtccatccttgaaacagc

SEQ ID NO: 62 - DNA, 18 bp, Artificial Sequence
  Synthetic oligonucleotide
caaccctgatgcctggag

SEQ ID NO: 63 - DNA, 24 bp, Artificial Sequence
  Synthetic oligonucleotide
cctccagtgctgtgttcccagaag

SEQ ID NO: 64 - DNA, 66 bp, Artificial Sequence
  Synthetic oligonucleotide
gatgtccatccttgaaacagcctcttctgggaacacagcactggaggtctccaggcatcagggttg

SEQ ID NO: 65 - DNA, 20 bp, Artificial Sequence
  Synthetic oligonucleotide
agcattgatcgatacctggc

SEQ ID NO: 66 - DNA, 19 bp, Artificial Sequence
  Synthetic oligonucleotide
ctacaagcattgtgcgtcg

SEQ ID NO: 67 - DNA, 24 bp, Artificial Sequence
  Synthetic oligonucleotide
attgttcacccaatgaagtcccgc

SEQ ID NO: 68 - DNA, 67 bp, Artificial Sequence
  Synthetic oligonucleotide
agcattgatcgatacctggctattgttcacccaatgaagtcccgccttcgacgcacaatgcttgtag

SEQ ID NO: 69 - DNA, 22 bp, Artificial Sequence
  Synthetic oligonucleotide
actggcataggaaatggtatcc

SEQ ID NO: 70 - DNA, 20 bp, Artificial Sequence
  Synthetic oligonucleotide
attgactgggtctctttgcc

SEQ ID NO: 71 - DNA, 24 bp, Artificial Sequence
  Synthetic oligonucleotide
ccacccagaccccatgtagcaaaa

SEQ ID NO: 72 - DNA, 76 bp, Artificial Sequence
  Synthetic oligonucleotide
actggcataggaaatggtatccagaatggaattttgctacatggggtctgggtgggggcaaagagacccagtcaat

SEQ ID NO: 73 - DNA, 19 bp, Artificial Sequence
  Synthetic oligonucleotide
cgacggttctgccctttat

SEQ ID NO: 74 - DNA, 19 bp, Artificial Sequence
  Synthetic oligonucleotide
tgctcctgctgggatactg

SEQ ID NO: 75 - DNA, 24 bp, Artificial Sequence
  Synthetic oligonucleotide
aatcgagatgaggacatcgcacca

SEQ ID NO: 76 - DNA, 66 bp, Artificial Sequence
  Synthetic oligonucleotide
cgacggttctgccctttatattaatcgagatgaggacatcgcaccatcagtatcccagcaggagca

SEQ ID NO: 77 - DNA, 20 bp, Artificial Sequence
  Synthetic oligonucleotide
tgtggttggagatgaagtgg

SEQ ID NO: 78 - DNA, 19 bp, Artificial Sequence
  Synthetic oligonucleotide
gtctacccactgggcaagg

SEQ ID NO: 79 - DNA, 24 bp, Artificial Sequence
  Synthetic oligonucleotide
ctccaccagggaccggtttatcaa

SEQ ID NO: 80 - DNA, 70 bp, Artificial Sequence
  Synthetic oligonucleotide
tgtggttggagatgaagtggtgttgataaaccggtccctggtggagcgaggccttgcccagtgggtagac

SEQ ID NO: 81 - DNA, 21 bp, Artificial Sequence
  Synthetic oligonucleotide
gtgtgtgaagctgaatgatgg

SEQ ID NO: 82 - DNA, 18 bp, Artificial Sequence
  Synthetic oligonucleotide
ctctgcaggcgcataggt

SEQ ID NO: 83 - DNA, 24 bp, Artificial Sequence
  Synthetic oligonucleotide
ccaaatcccaggacaggcatgaag

SEQ ID NO: 84 - DNA, 67 bp, Artificial Sequence
  Synthetic oligonucleotide
gtgtgtgaagctgaatgatggtcacttcatgcctgtcctgggatttggcacctatgcgcctgcagag

SEQ ID NO: 85 - DNA, 23 bp, Artificial Sequence
  Synthetic oligonucleotide
gctttgcctgatgtctaccagaa

SEQ ID NO: 86 - DNA, 21 bp, Artificial Sequence
  Synthetic oligonucleotide
gtccagtcaccggcatagaga

SEQ ID NO: 87 - DNA, 23 bp, Artificial Sequence
  Synthetic oligonucleotide
tgcgtcaccatccacacacaggg

SEQ ID NO: 88 - DNA, 75 bp, Artificial Sequence
  Synthetic oligonucleotide
gctttgcctgatgtctaccagaagccctgtgtgtggatggtgacgcagaggacgtctctatgccggtgactggac

SEQ ID NO: 89 - DNA, 20 bp, Artificial Sequence
  Synthetic oligonucleotide
cgcttctatggcgctgagat

SEQ ID NO: 90 - DNA, 20 bp, Artificial Sequence
  Synthetic oligonucleotide
tcccggtacaccacgttctt

SEQ ID NO: 91 - DNA, 24 bp, Artificial Sequence
  Synthetic oligonucleotide
cagccctggactacctgcactcgg

SEQ ID NO: 92 - DNA, 71 bp, Artificial Sequence
  Synthetic oligonucleotide
cgcttctatggcgctgagattgtgtcagccctggactacctgcactcggagaagaacgtggtgtaccggga

SEQ ID NO: 93 - DNA, 19 bp, Artificial Sequence
  Synthetic oligonucleotide
tcctgccacccttcaaacc

SEQ ID NO: 94 - DNA, 21 bp, Artificial Sequence
  Synthetic oligonucleotide
ggcggtaaattcatcatcgaa

SEQ ID NO: 95 - DNA, 24 bp, Artificial Sequence
  Synthetic oligonucleotide
caggtcacgtccgaggtcgacaca

SEQ ID NO: 96 - DNA, 71 bp, Artificial Sequence
  Synthetic oligonucleotide
tcctgccacccttcaaacctcaggtcacgtccgaggtcgacacaaggtacttcgatgatgaatttaccgcc

SEQ ID NO: 97 - DNA, 25 bp, Artificial Sequence
  Synthetic oligonucleotide
ttgtctctgccttggactatctaca

SEQ ID NO: 98 - DNA, 24 bp, Artificial Sequence
  Synthetic oligonucleotide
ccagcattagattctccaacttga

SEQ ID NO: 99 - DNA, 23 bp, Artificial Sequence
  Synthetic oligonucleotide
tcacggtacacaatctttccgga

SEQ ID NO: 100 - DNA, 75 bp, Artificial Sequence
  Synthetic oligonucleotide
ttgtctctgccttggactatctacattccggaaagattgtgtaccgtgatctcaagttggagaatctaatgctgg

SEQ ID NO: 101 - DNA, 21 bp, Artificial Sequence
  Synthetic oligonucleotide
gaggaatatggaatccaaggg

SEQ ID NO: 102 - DNA, 18 bp, Artificial Sequence
  Synthetic oligonucleotide
gtggcggagatcaagagg

SEQ ID NO: 103 - DNA, 24 bp, Artificial Sequence
  Synthetic oligonucleotide
ccagttcctgccgtctgctcttct

SEQ ID NO: 104 - DNA, 66 bp, Artificial Sequence
  Synthetic oligonucleotide
gaggaatatggaatccaagggggccagttcctgccgtctgctcttctgcctcttgatctccgccac

SEQ ID NO: 105 - DNA, 18 bp, Artificial Sequence
  Synthetic oligonucleotide
gatgcagctggaacccaa

SEQ ID NO: 106 - DNA, 18 bp, Artificial Sequence
  Synthetic oligonucleotide
ctccagctcagtggggaa

SEQ ID NO: 107 - DNA, 24 bp, Artificial Sequence
  Synthetic oligonucleotide
cctgaaacttgcatctcctgctgc

SEQ ID NO: 108 - DNA, 66 bp, Artificial Sequence
  Synthetic oligonucleotide
gatgcagctggaacccaagctgcagcaggagatgcaagtttcaggatgttccccactgagctggag

SEQ ID NO: 109 - DNA, 20 bp, Artificial Sequence
  Synthetic oligonucleotide
cacgtctgtccctctctgct

SEQ ID NO: 110 - DNA, 21 bp, Artificial Sequence
  Synthetic oligonucleotide
gaccgtggctcaactttgtat

SEQ ID NO: 111 - DNA, 24 bp, Artificial Sequence
  Synthetic oligonucleotide
tctctgtagggcccagctctcagg

SEQ ID NO: 112 - DNA, 67 bp, Artificial Sequence
  Synthetic oligonucleotide
cacgtctgtccctctctgctttctctgtagggcccagctctcaggaatacaaagttgagccacggtc

SEQ ID NO: 113 - DNA, 21 bp, Artificial Sequence
  Synthetic oligonucleotide
tcgcttagtctgcacctcaac

SEQ ID NO: 114 - DNA, 19 bp, Artificial Sequence
  Synthetic oligonucleotide
tctgagccccagtttttcc

SEQ ID NO: 115 - DNA, 24 bp, Artificial Sequence
  Synthetic oligonucleotide
taaacagggcagtcactttccgca

SEQ ID NO: 116 - DNA, 70 bp, Artificial Sequence
  Synthetic oligonucleotide
tcgcttagtctgcacctcaaccgtgcggaaagtgactgccctgtttactgaggaaaaactggggctcaga

SEQ ID NO: 117 - DNA, 20 bp, Artificial Sequence
  Synthetic oligonucleotide
agttcctcaatggtgccaac

SEQ ID NO: 118 - DNA, 18 bp, Artificial Sequence
  Synthetic oligonucleotide
agcactagcctggagggc

SEQ ID NO: 119 - DNA, 24 bp, Artificial Sequence
  Synthetic oligonucleotide
catgctgttgagacgctcgacctc

SEQ ID NO: 120 - DNA, 67 bp, Artificial Sequence
  Synthetic oligonucleotide
agttcctcaatggtgccaaccccatgctgttgagacgctcgacctctctgccctccaggctagtgct

SEQ ID NO: 121 - DNA, 19 bp, Artificial Sequence
  Synthetic oligonucleotide
gagctgcaggacttcgtga

SEQ ID NO: 122 - DNA, 18 bp, Artificial Sequence
  Synthetic oligonucleotide
gaagcctgaggacttgcg

SEQ ID NO: 123 - DNA, 24 bp, Artificial Sequence
  Synthetic oligonucleotide
ccgcatgccgtacacgtagacatc

SEQ ID NO: 124 - DNA, 66 bp, Artificial Sequence
  Synthetic oligonucleotide
gagctgcaggacttcgtgaacgatgtctacgtgtacggcatgcggggccgcaagtcctcaggcttc

SEQ ID NO: 125 - DNA, 20 bp, Artificial Sequence
  Synthetic oligonucleotide
gtctctgggctgtcagcttt

SEQ ID NO: 126 - DNA, 23 bp, Artificial Sequence
  Synthetic oligonucleotide
tgggtataagatccagaacttgc

SEQ ID NO: 127 - DNA, 26 bp, Artificial Sequence
  Synthetic oligonucleotide
tccatgtgtttgatttctcctcaggc

SEQ ID NO: 128 - DNA, 80 bp, Artificial Sequence
  Synthetic oligonucleotide
gtctctgggctgtcagctttcctttctccatgtgtttgatttctcctcaggctggtagcaagttctggatcttataccca

SEQ ID NO: 129 - DNA, 19 bp, Artificial Sequence
  Synthetic oligonucleotide
tggttcatccagcacaagg

SEQ ID NO: 130 - DNA, 18 bp, Artificial Sequence
  Synthetic oligonucleotide
cataaatccggggcacct

SEQ ID NO: 131 - DNA, 24 bp, Artificial Sequence
  Synthetic oligonucleotide
tactctcccaacatgcgctggatc

SEQ ID NO: 132 - DNA, 67 bp, Artificial Sequence
  Synthetic oligonucleotide
tggttcatccagcacaaggtctactctcccaacatgcgctggatcatccaggtgccccggatttatg

SEQ ID NO: 133 - DNA, 20 bp, Artificial Sequence
  Synthetic oligonucleotide
ccgtgaaagctgctctgtaa

SEQ ID NO: 134 - DNA, 20 bp, Artificial Sequence
  Synthetic oligonucleotide
ttgcagtgggaagaacagtc

SEQ ID NO: 135 - DNA, 24 bp, Artificial Sequence
  Synthetic oligonucleotide
aagctgacacagccctcccaagtg

SEQ ID NO: 136 - DNA, 69 bp, Artificial Sequence
  Synthetic oligonucleotide
ccgtgaaagctgctctgtaaaagctgacacagccctcccaagtgagcaggactgttcttcccactgcaa

SEQ ID NO: 137 - DNA, 20 bp, Artificial Sequence
  Synthetic oligonucleotide
tgaaagtccaaaaccaggaa

SEQ ID NO: 138 - DNA, 20 bp, Artificial Sequence
  Synthetic oligonucleotide
cagaaccaaggctatcacca

SEQ ID NO: 139 - DNA, 24 bp, Artificial Sequence
  Synthetic oligonucleotide
ccaaagaactcgtgtccctcgagc

SEQ ID NO: 140 - DNA, 74 bp, Artificial Sequence
  Synthetic oligonucleotide
tgaaagtccaaaaccaggaaaattccaaagaactcgtgtccctcgagctgaatctggtgatagccttggttctg

SEQ ID NO: 141 - DNA, 22 bp, Artificial Sequence
  Synthetic oligonucleotide
ccaccttggaccaaagtaaagc

SEQ ID NO: 142 - DNA, 21 bp, Artificial Sequence
  Synthetic oligonucleotide
tctcagcgtcacctggtagga

SEQ ID NO: 143 - DNA, 22 bp, Artificial Sequence
  Synthetic oligonucleotide
ctccccaacacgctgaaacccg

SEQ ID NO: 144 - DNA, 83 bp, Artificial Sequence
  Synthetic oligonucleotide
ccaccttggaccaaagtaaagcgtggaatcgttaccgcctccccaacacgctgaaacccgattcctaccgggtgacgctgaga

SEQ ID NO: 145 - DNA, 23 bp, Artificial Sequence
  Synthetic oligonucleotide
caagacactaagggcgactacca

SEQ ID NO: 146 - DNA, 19 bp, Artificial Sequence
  Synthetic oligonucleotide
cgtgtcgggcttcagtcat

SEQ ID NO: 147 - DNA, 24 bp, Artificial Sequence
  Synthetic oligonucleotide
ccaccacacaggtacagcagcgct

SEQ ID NO: 148 - DNA, 71 bp, Artificial Sequence
  Synthetic oligonucleotide
caagacactaagggcgactaccagaaagcgctgctgtacctgtgtggtggagatgactgaagcccgacacg

SEQ ID NO: 149 - DNA, 20 bp, Artificial Sequence
  Synthetic oligonucleotide
ggacagcaggaatgtgtttc

SEQ ID NO: 150 - DNA, 20 bp, Artificial Sequence
  Synthetic oligonucleotide
acccactcgatttgtttctg

SEQ ID NO: 151 - DNA, 22 bp, Artificial Sequence
  Synthetic oligonucleotide
cattggctccccgtgacctgta

SEQ ID NO: 152 - DNA, 69 bp, Artificial Sequence
  Synthetic oligonucleotide
ggacagcaggaatgtgtttctccatacaggtcacggggagccaatggttcagaaacaaatcgagtgggt

SEQ ID NO: 153 - DNA, 20 bp, Artificial Sequence
  Synthetic oligonucleotide
gatgaagcctttcgcaagtt

SEQ ID NO: 154 - DNA, 20 bp, Artificial Sequence
  Synthetic oligonucleotide
aggtctccacacagcacaag

SEQ ID NO: 155 - DNA, 21 bp, Artificial Sequence
  Synthetic oligonucleotide
ctttcgggaagccaggccctt

SEQ ID NO: 156 - DNA, 68 bp, Artificial Sequence
  Synthetic oligonucleotide
gatgaagcctttcgcaagttcctgaagggcctggcttcccgaaagccccttgtgctgtgtggagacct

SEQ ID NO: 157 - DNA, 20 bp, Artificial Sequence
  Synthetic oligonucleotide
ccagcctgataaaggtcctg

SEQ ID NO: 158 - DNA, 20 bp, Artificial Sequence
  Synthetic oligonucleotide
cactctgaatccttgctgga

SEQ ID NO: 159 - DNA, 23 bp, Artificial Sequence
  Synthetic oligonucleotide
aggacaggacctcccaaccaagc

SEQ ID NO: 160 - DNA, 70 bp, Artificial Sequence
  Synthetic oligonucleotide
ccagcctgataaaggtcctgcgggcaggacaggacctcccaaccaagccctccagcaaggattcagagtg

SEQ ID NO: 161 - DNA, 18 bp, Artificial Sequence
  Synthetic oligonucleotide
gcctcaagagctggttcg

SEQ ID NO: 162 - DNA, 18 bp, Artificial Sequence
  Synthetic oligonucleotide
cctgcaccttctccacca

SEQ ID NO: 163 - DNA, 22 bp, Artificial Sequence
  Synthetic oligonucleotide
actggcgctgcatgtcttccac

SEQ ID NO: 164 - DNA, 75 bp, Artificial Sequence
  Synthetic oligonucleotide
gcctcaagagctggttcgagcccctggtggaagacatgcagcgccagtgggccgggctggtggagaaggtgcagg

SEQ ID NO: 165 - DNA, 18 bp, Artificial Sequence
  Synthetic oligonucleotide
gaggtcctggagtgcgtg

SEQ ID NO: 166 - DNA, 18 bp, Artificial Sequence
  Synthetic oligonucleotide
aggtgccagcttctccct

SEQ ID NO: 167 - DNA, 24 bp, Artificial Sequence
  Synthetic oligonucleotide
ccttaagcgaggtcagctccacca

SEQ ID NO: 168 - DNA, 66 bp, Artificial Sequence
  Synthetic oligonucleotide
gaggtcctggagtgcgtgagcctggtggagctgacctcgcttaagggcagggagaagctggcacct

SEQ ID NO: 169 - DNA, 18 bp, Artificial Sequence
  Synthetic oligonucleotide
gtgtgggtgccagtcctc

SEQ ID NO: 170 - DNA, 19 bp, Artificial Sequence
  Synthetic oligonucleotide
cccttcagccctctcaaag

SEQ ID NO: 171 - DNA, 24 bp, Artificial Sequence
  Synthetic oligonucleotide
ctccttcccttccccttctcctga

SEQ ID NO: 172 - DNA, 66 bp, Artificial Sequence
  Synthetic oligonucleotide
gtgtgggtgccagtcctcctcaggagaaggggaagggaaggaggccactttgagagggctgaaggg

SEQ ID NO: 173 - DNA, 19 bp, Artificial Sequence
  Synthetic oligonucleotide
cgacttcaccgcacctgat

SEQ ID NO: 174 - DNA, 22 bp, Artificial Sequence
  Synthetic oligonucleotide
tgacacaagtgggactgggata

SEQ ID NO: 175 - DNA, 22 bp, Artificial Sequence
  Synthetic oligonucleotide
accatgccgccagggtaccaca

SEQ ID NO: 176 - DNA, 77 bp, Artificial Sequence
  Synthetic oligonucleotide
cgacttcaccgcacctgatgtgtggtaccctggcggcatggtgagcagagtgccctatcccagtcccacttgtgtca

SEQ ID NO: 177 - DNA, 20 bp, Artificial Sequence
  Synthetic oligonucleotide
cagtagagatccccgcaact

SEQ ID NO: 178 - DNA, 20 bp, Artificial Sequence
  Synthetic oligonucleotide
acaagcacatggctatggaa

SEQ ID NO: 179 - DNA, 22 bp, Artificial Sequence
  Synthetic oligonucleotide
cttgtccttgggtcaccctgca

SEQ ID NO: 180 - DNA, 64 bp, Artificial Sequence
  Synthetic oligonucleotide
cagtagagatccccgcaactcgcttgtccttgggtcaccctgcattccatagccatgtgcttgt

SEQ ID NO: 181 - DNA, 19 bp, Artificial Sequence
  Synthetic oligonucleotide
cacggtctcgtggtgaagt

SEQ ID NO: 182 - DNA, 18 bp, Artificial Sequence
  Synthetic oligonucleotide
cagttgcttgcccaggac

SEQ ID NO: 183 - DNA, 24 bp, Artificial Sequence
  Synthetic oligonucleotide
atgccagacccagacaaagcatca

SEQ ID NO: 184 - DNA, 67 bp, Artificial Sequence
  Synthetic oligonucleotide
cacggtctcgtggtgaagtcaatgccagacccagacaaagcatcagcttgtcctgggcaagcaactg

SEQ ID NO: 185 - DNA, 20 bp, Artificial Sequence
  Synthetic oligonucleotide
tggtccctagaacaagaggc

SEQ ID NO: 186 - DNA, 20 bp, Artificial Sequence
  Synthetic oligonucleotide
tgatggaggatcagagggag

SEQ ID NO: 187 - DNA, 24 bp, Artificial Sequence
  Synthetic oligonucleotide
taaaaccgggctttcacccaacct

SEQ ID NO: 188 - DNA, 66 bp, Artificial Sequence
  Synthetic oligonucleotide
tggtccctagaacaagaggcttaaaaccgggctttcacccaacctgctccctctgatcctccatca

SEQ ID NO: 189 - DNA, 18 bp, Artificial Sequence
  Synthetic oligonucleotide
cggcccatcagcttctac

SEQ ID NO: 190 - DNA, 20 bp, Artificial Sequence
  Synthetic oligonucleotide
ctctggccaaagatacagcg

SEQ ID NO: 191 - DNA, 24 bp, Artificial Sequence
  Synthetic oligonucleotide
ctgggctccaaccagcttcagtct

SEQ ID NO: 192 - DNA, 67 bp, Artificial Sequence
  Synthetic oligonucleotide
cggcccatcagcttctaccagctgggctccaaccagcttcagtctaacgctgtatctttggccagag

SEQ ID NO: 193 - DNA, 20 bp, Artificial Sequence
  Synthetic oligonucleotide
tggactaatctgtgggagca

SEQ ID NO: 194 - DNA, 21 bp, Artificial Sequence
  Synthetic oligonucleotide
aaacacccttcaacacagtcc

SEQ ID NO: 195 - DNA, 23 bp, Artificial Sequence
  Synthetic oligonucleotide
agtatcacccagggtgcagccac

SEQ ID NO: 196 - DNA, 77 bp, Artificial Sequence
  Synthetic oligonucleotide
tggactaatctgtgggagcagtttattccagtatcacccagggtgcagccacaccaggactgtgttgaagggtgttt

SEQ ID NO: 197 - DNA, 22 bp, Artificial Sequence
  Synthetic oligonucleotide
tgctttctacacatgttcaggg

SEQ ID NO: 198 - DNA, 18 bp, Artificial Sequence
  Synthetic oligonucleotide
gttgtggatcggctcgtt

SEQ ID NO: 199 - DNA, 24 bp, Artificial Sequence
  Synthetic oligonucleotide
ccagctgtcttcgacacttctcgc

SEQ ID NO: 200 - DNA, 73 bp, Artificial Sequence
  Synthetic oligonucleotide
tgctttctacacatgttcagggatttttcaccagctgtcttcgacacttctcgcaaacgagccgatccacaac

SEQ ID NO: 201 - DNA, 18 bp, Artificial Sequence
  Synthetic oligonucleotide
ccgctttcgctacagcat

SEQ ID NO: 202 - DNA, 21 bp, Artificial Sequence
  Synthetic oligonucleotide
tgggagtatcggatgtagctg

SEQ ID NO: 203 - DNA, 24 bp, Artificial Sequence
  Synthetic oligonucleotide
tccagcctgtctccagtaggccac

SEQ ID NO: 204 - DNA, 66 bp, Artificial Sequence
  Synthetic oligonucleotide
ccgctttcgctacagcatggtggcctactggagacaggctggactcagctacatccgatactccca

SEQ ID NO: 205 - DNA, 18 bp, Artificial Sequence
  Synthetic oligonucleotide
gtcgaccgactgaaacgg

SEQ ID NO: 206 - DNA, 18 bp, Artificial Sequence
  Synthetic oligonucleotide
ctctacttccggccctgg

SEQ ID NO: 207 - DNA, 24 bp, Artificial Sequence
  Synthetic oligonucleotide
ctacccgccatcgcaatgcattat

SEQ ID NO: 208 - DNA, 82 bp, Artificial Sequence
  Synthetic oligonucleotide
gtcgaccgactgaaacggcggcccataatgcattgcgatggcgggtaggcgtgtgggggcggagccagggccggaagtagag

SEQ ID NO: 209 - DNA, 20 bp, Artificial Sequence
  Synthetic oligonucleotide
gatcgactccagcaccgtag

SEQ ID NO: 210 - DNA, 19 bp, Artificial Sequence
  Synthetic oligonucleotide
gaactgtatcacggccacg

SEQ ID NO: 211 - DNA, 24 bp, Artificial Sequence
  Synthetic oligonucleotide
cgggctatggctgtcttcaatcct

SEQ ID NO: 212 - DNA, 67 bp, Artificial Sequence
  Synthetic oligonucleotide
gatcgactccagcaccgtagagaggattgaagacagccatagcccgggcgtggccgtgatacagttc

SEQ ID NO: 213 - DNA, 20 bp, Artificial Sequence
  Synthetic oligonucleotide
catcttccaggaggaccact

SEQ ID NO: 214 - DNA, 20 bp, Artificial Sequence
  Synthetic oligonucleotide
tccgaccttcaatcatttca

SEQ ID NO: 215 - DNA, 24 bp, Artificial Sequence
  Synthetic oligonucleotide
ctctgtggcaccctggactacctg

SEQ ID NO: 216 - DNA, 69 bp, Artificial Sequence
  Synthetic oligonucleotide
catcttccaggaggaccactctctgtggcaccctggactacctgccccctgaaatgattgaaggtcgga

SEQ ID NO: 217 - DNA, 21 bp, Artificial Sequence
  Synthetic oligonucleotide
agctgcagaagagctgcacat

SEQ ID NO: 218 - DNA, 20 bp, Artificial Sequence
  Synthetic oligonucleotide
gcatctgccaactcctccat

SEQ ID NO: 219 - DNA, 22 bp, Artificial Sequence
  Synthetic oligonucleotide
tgacgagcagcgaacagccacg

SEQ ID NO: 220 - DNA, 67 bp, Artificial Sequence
  Synthetic oligonucleotide
agctgcagaagagctgcacatttgacgagcagcgaacagccacgatcatggaggagttggcagatgc

SEQ ID NO: 221 - DNA, 20 bp, Artificial Sequence
  Synthetic oligonucleotide
ggctatgtctttgcaccagc

SEQ ID NO: 222 - DNA, 18 bp, Artificial Sequence
  Synthetic oligonucleotide
atccgtcagcgcatcact

SEQ ID NO: 223 - DNA, 24 bp, Artificial Sequence
  Synthetic oligonucleotide
accagcgccaacgacagtgagata

SEQ ID NO: 224 - DNA, 66 bp, Artificial Sequence
  Synthetic oligonucleotide
ggctatgtctttgcaccagccaccagcgccaacgacagtgagatatccagtgatgcgctgacggat

SEQ ID NO: 225 - DNA, 19 bp, Artificial Sequence
  Synthetic oligonucleotide
gaggccagctaggaagcaa

SEQ ID NO: 226 - DNA, 19 bp, Artificial Sequence
  Synthetic oligonucleotide
caggaagggcagctactgg

SEQ ID NO: 227 - DNA, 24 bp, Artificial Sequence
  Synthetic oligonucleotide
tctgagatcccacattgcctccaa

SEQ ID NO: 228 - DNA, 66 bp, Artificial Sequence
  Synthetic oligonucleotide
gaggccagctaggaagcaagggttggaggcaatgtgggatctcagacccagtagctgcccttcctg

SEQ ID NO: 229 - DNA, 19 bp, Artificial Sequence
  Synthetic oligonucleotide
gggtcaggggcctcgagat

SEQ ID NO: 230 - DNA, 21 bp, Artificial Sequence
  Synthetic oligonucleotide
ctgctcactcggctcaaactc

SEQ ID NO: 231 - DNA, 24 bp, Artificial Sequence
  Synthetic oligonucleotide
tgggcccagagcatgttccagatc

SEQ ID NO: 232 - DNA, 73 bp, Artificial Sequence
  Synthetic oligonucleotide
gggtcaggggcctcgagatcgggcttgggcccagagcatgttccagatcccagagtttgagccgagtgagcag

SEQ ID NO: 233 - DNA, 20 bp, Artificial Sequence
  Synthetic oligonucleotide
actcctgcaatgaaccctgt

SEQ ID NO: 234 - DNA, 18 bp, Artificial Sequence
  Synthetic oligonucleotide
acaaacagctccccacga

SEQ ID NO: 235 - DNA, 24 bp, Artificial Sequence
  Synthetic oligonucleotide
acaccggatttagctcttgtcggc

SEQ ID NO: 236 - DNA, 66 bp, Artificial Sequence
  Synthetic oligonucleotide
actcctgcaatgaaccctgttgacaccggatttagctcttgtcggccttcgtggggagctgtttgt

SEQ ID NO: 237 - DNA, 20 bp, Artificial Sequence
  Synthetic oligonucleotide
ccattcccaccattctacct

SEQ ID NO: 238 - DNA, 20 bp, Artificial Sequence
  Synthetic oligonucleotide
gggaacatagacccaccaat

SEQ ID NO: 239 - DNA, 21 bp, Artificial Sequence
  Synthetic oligonucleotide
acaccccagacgtcctggcct

SEQ ID NO: 240 - DNA, 66 bp, Artificial Sequence
  Synthetic oligonucleotide
ccattcccaccattctacctgaggccaggacgtctggggtgtggggattggtgggtctatgttccc

SEQ ID NO: 241 - DNA, 18 bp, Artificial Sequence
  Synthetic oligonucleotide
ccgccgtggacacagact

SEQ ID NO: 242 - DNA, 21 bp, Artificial Sequence
  Synthetic oligonucleotide
ttgccgtcagaaaacatgtca

SEQ ID NO: 243 - DNA, 25 bp, Artificial Sequence
  Synthetic oligonucleotide
tgccactcggaaaaagacctctcgg

SEQ ID NO: 244 - DNA, 70 bp, Artificial Sequence
  Synthetic oligonucleotide
ccgccgtggacacagactccccccgagaggtctttttccgagtggcagctgacatgttttctgacggcaa

SEQ ID NO: 245 - DNA, 20 bp, Artificial Sequence
  Synthetic oligonucleotide
cctggagggtcctgtacaat

SEQ ID NO: 246 - DNA, 19 bp, Artificial Sequence
  Synthetic oligonucleotide
ctaattgggctccatctcg

SEQ ID NO: 247 - DNA, 24 bp, Artificial Sequence
  Synthetic oligonucleotide
catcatgggactcctgcccttacc

SEQ ID NO: 248 - DNA, 83 bp, Artificial Sequence
  Synthetic oligonucleotide
cctggagggtcctgtacaatctcatcatgggactcctgcccttacccaggggccacagagcccccgagatggagcccaattag

SEQ ID NO: 249 - DNA, 25 bp, Artificial Sequence
  Synthetic oligonucleotide
cagatggacctagtacccactgaga

SEQ ID NO: 250 - DNA, 24 bp, Artificial Sequence
  Synthetic oligonucleotide
cctatgatttaagggcatttttcc

SEQ ID NO: 251 - DNA, 22 bp, Artificial Sequence
  Synthetic oligonucleotide
ttccacgccgaaggacagcgat

SEQ ID NO: 252 - DNA, 73 bp, Artificial Sequence
  Synthetic oligonucleotide
cagatggacctagtacccactgagatttccacgccgaaggacagcgatgggaaaaatgcccttaaatcatagg

SEQ ID NO: 253 - DNA, 20 bp, Artificial Sequence
  Synthetic oligonucleotide
gtggcagaaatctacctggc

SEQ ID NO: 254 - DNA, 18 bp, Artificial Sequence
  Synthetic oligonucleotide
gaagggcaagcccaagac

SEQ ID NO: 255 - DNA, 24 bp, Artificial Sequence
  Synthetic oligonucleotide
acctggcagcctctgatctggtgt

SEQ ID NO: 256 - DNA, 66 bp, Artificial Sequence
  Synthetic oligonucleotide
gtggcagaaatctacctggccaacctggcagcctctgatctggtgtttgtcttgggcttgcccttc

SEQ ID NO: 257 - DNA, 18 bp, Artificial Sequence
  Synthetic oligonucleotide
gagctccgcaaggatgac

SEQ ID NO: 258 - DNA, 20 bp, Artificial Sequence
  Synthetic oligonucleotide
cttgttgttcaccaggacga

SEQ ID NO: 259 - DNA, 24 bp, Artificial Sequence
  Synthetic oligonucleotide
caagggtctccagcacctctacgc

SEQ ID NO: 260 - DNA, 66 bp, Artificial Sequence
  Synthetic oligonucleotide
gagctccgcaaggatgacttcaagggtctccagcacctctacgccctcgtcctggtgaacaacaag

SEQ ID NO: 261 - DNA, 23 bp, Artificial Sequence
  Synthetic oligonucleotide
attcctatggctctgcaattgtc

SEQ ID NO: 262 - DNA, 21 bp, Artificial Sequence
  Synthetic oligonucleotide
ggcaggagtgaatggctcttc

SEQ ID NO: 263 - DNA, 23 bp, Artificial Sequence
  Synthetic oligonucleotide
ccggttaactgtggcctgtgccc

SEQ ID NO: 264 - DNA, 70 bp, Artificial Sequence
  Synthetic oligonucleotide
attcctatggctctgcaattgtcaccggttaactgtggcctgtgcccaggaagagccattcactcctgcc

SEQ ID NO: 265 - DNA, 20 bp, Artificial Sequence
  Synthetic oligonucleotide
cctgcaaaagggaacaagag

SEQ ID NO: 266 - DNA, 20 bp, Artificial Sequence
  Synthetic oligonucleotide
cgtggttgactctgatctcg

SEQ ID NO: 267 - DNA, 21 bp, Artificial Sequence
  Synthetic oligonucleotide
cttcgcctccagatggctccc

SEQ ID NO: 268 - DNA, 76 bp, Artificial Sequence
  Synthetic oligonucleotide
cctgcaaaagggaacaagagcccttcgcctccagatggctcccctgccgccacccccgagatcagagtcaaccacg

SEQ ID NO: 269 - DNA, 20 bp, Artificial Sequence
  Synthetic oligonucleotide
ttcaggtggatgaggagaca

SEQ ID NO: 270 - DNA, 19 bp, Artificial Sequence
  Synthetic oligonucleotide
cacacagcagtggcaaaag

SEQ ID NO: 271 - DNA, 29 bp, Artificial Sequence
  Synthetic oligonucleotide
tctgccagacgcttcctatcactctattc

SEQ ID NO: 272 - DNA, 73 bp, Artificial Sequence
  Synthetic oligonucleotide
ttcaggtggatgaggagacagaatagagtgataggaagcgtctggcagatactccttttgccactgctgtgtg

SEQ ID NO: 273 - DNA, 20 bp, Artificial Sequence
  Synthetic oligonucleotide
gtgcagaccttggttcacct

SEQ ID NO: 274 - DNA, 19 bp, Artificial Sequence
  Synthetic oligonucleotide
cttagttggcgcacagcac

SEQ ID NO: 275 - DNA, 24 bp, Artificial Sequence
  Synthetic oligonucleotide
tgaaccccgagtatgtccccaaac

SEQ ID NO: 276 - DNA, 66 bp, Artificial Sequence
  Synthetic oligonucleotide
gtgcagaccttggttcaccttatgaaccccgagtatgtccccaaaccgtgctgtgcgccaactaag

SEQ ID NO: 277 - DNA, 18 bp, Artificial Sequence
  Synthetic oligonucleotide
accactttggccatccct

SEQ ID NO: 278 - DNA, 19 bp, Artificial Sequence
  Synthetic oligonucleotide
gcggtgtttgtacccagtg

SEQ ID NO: 279 - DNA, 24 bp, Artificial Sequence
  Synthetic oligonucleotide
attcacattaccatagcggcccca

SEQ ID NO: 280 - DNA, 67 bp, Artificial Sequence
  Synthetic oligonucleotide
accactttggccatccctgcatttggggccgctatggtaatgtgaatgcactgggtacaaacaccgc

SEQ ID NO: 281 - DNA, 20 bp, Artificial Sequence
  Synthetic oligonucleotide
tcagggggctagaaatctgt

SEQ ID NO: 282 - DNA, 20 bp, Artificial Sequence
  Synthetic oligonucleotide
ccattccagttgatctgtgg

SEQ ID NO: 283 - DNA, 23 bp, Artificial Sequence
  Synthetic oligonucleotide
ctatgggcccttcaccaacatgc

SEQ ID NO: 284 - DNA, 65 bp, Artificial Sequence
  Synthetic oligonucleotide
tcagggggctagaaatctgttgctatgggcccttcaccaacatgcccacagatcaactggaatgg

SEQ ID NO: 285 - DNA, 20 bp, Artificial Sequence
  Synthetic oligonucleotide
agttcgtgctttgcaagatg

SEQ ID NO: 286 - DNA, 20 bp, Artificial Sequence
  Synthetic oligonucleotide
aaggtaagctgggtctgctg

SEQ ID NO: 287 - DNA, 29 bp, Artificial Sequence
  Synthetic oligonucleotide
cattcttcactgcttcataaagctctgca

SEQ ID NO: 288 - DNA, 70 bp, Artificial Sequence
  Synthetic oligonucleotide
agttcgtgctttgcaagatggtgcagagctttatgaagcagtgaagaatgcagcagacccagcttacctt

SEQ ID NO: 289 - DNA, 18 bp, Artificial Sequence
  Synthetic oligonucleotide
gaggtccgagcgatgtga

SEQ ID NO: 290 - DNA, 22 bp, Artificial Sequence
  Synthetic oligonucleotide
agttattttcgagacaggaggc

SEQ ID NO: 291 - DNA, 24 bp, Artificial Sequence
  Synthetic oligonucleotide
cgctcgtctcttcctctctcctgc

SEQ ID NO: 292 - DNA, 77 bp, Artificial Sequence
  Synthetic oligonucleotide
gaggtccgagcgatgtgaccaggccgccatcgctcgtctcttcctctctcctgccgcctcctgtctcgaaaataact

SEQ ID NO: 293 - DNA, 18 bp, Artificial Sequence
  Synthetic oligonucleotide
ccatatcgcccaattcca

SEQ ID NO: 294 - DNA, 19 bp, Artificial Sequence
  Synthetic oligonucleotide
ccagtgattccggtcacaa

SEQ ID NO: 295 - DNA, 24 bp, Artificial Sequence
  Synthetic oligonucleotide
catgggtacctcctcctggaatgc

SEQ ID NO: 296 - DNA, 66 bp, Artificial Sequence
  Synthetic oligonucleotide
ccatatcgcccaattccagtgacatgggtacctcctcctggaatgcattgtgaccggaatcactgg

SEQ ID NO: 297 - DNA, 20 bp, Artificial Sequence
  Synthetic oligonucleotide
gttgggacacagttggtctg

SEQ ID NO: 298 - DNA, 20 bp, Artificial Sequence
  Synthetic oligonucleotide
tgaagcagtcagttgtgctg

SEQ ID NO: 299 - DNA, 23 bp, Artificial Sequence
  Synthetic oligonucleotide
cagtcggcccaggacggtctact

SEQ ID NO: 300 - DNA, 63 bp, Artificial Sequence
  Synthetic oligonucleotide
gttgggacacagttggtctgcagtcggcccaggacggtctactcagcacaactgactgcttca

SEQ ID NO: 301 - DNA, 21 bp, Artificial Sequence
  Synthetic oligonucleotide
ccgaggttaatccagcacgta

SEQ ID NO: 302 - DNA, 21 bp, Artificial Sequence
  Synthetic oligonucleotide
aagacatggcgctctcagttc

SEQ ID NO: 303 - DNA, 23 bp, Artificial Sequence
  Synthetic oligonucleotide
tgctgggagcctacacttggccc

SEQ ID NO: 304 - DNA, 68 bp, Artificial Sequence
  Synthetic oligonucleotide
ccgaggttaatccagcacgtatggggccaagtgtaggctcccagcaggaactgagagcgccatgtctt

SEQ ID NO: 305 - DNA, 19 bp, Artificial Sequence
  Synthetic oligonucleotide
atgtctgagtgtgaggcgg

SEQ ID NO: 306 - DNA, 20 bp, Artificial Sequence
  Synthetic oligonucleotide
aggccttatgctggtgacag

SEQ ID NO: 307 - DNA, 24 bp, Artificial Sequence
  Synthetic oligonucleotide
atgctctgccctctgcatctcaga

SEQ ID NO: 308 - DNA, 69 bp, Artificial Sequence
  Synthetic oligonucleotide
atgtctgagtgtgaggcgggcgctctgagatgcagagggcagagcatctctgtcaccagcataaggcct

SEQ ID NO: 309 - DNA, 18 bp, Artificial Sequence
  Synthetic oligonucleotide
aggacccagctccatgtg

SEQ ID NO: 310 - DNA, 19 bp, Artificial Sequence
  Synthetic oligonucleotide
cctacattccgtgccattg

SEQ ID NO: 311 - DNA, 24 bp, Artificial Sequence
  Synthetic oligonucleotide
cagtacactggcgtccattccctg

SEQ ID NO: 312 - DNA, 68 bp, Artificial Sequence
  Synthetic oligonucleotide
aggacccagctccatgtgcgttctcagggaatggacgccagtgtactgccaatggcacggaatgtagg

SEQ ID NO: 313 - DNA, 20 bp, Artificial Sequence
  Synthetic oligonucleotide
ccaccaccatccttaccatc

SEQ ID NO: 314 - DNA, 18 bp, Artificial Sequence
  Synthetic oligonucleotide
gatccactgccctgatcg

SEQ ID NO: 315 - DNA, 24 bp, Artificial Sequence
  Synthetic oligonucleotide
tcttcacctgctcgggaatctgtg

SEQ ID NO: 316 - DNA, 69 bp, Artificial Sequence
  Synthetic oligonucleotide
ccaccaccatccttaccatcatcacagattcccgagcaggtgaagaaggctcgatcagggcagtggatc

SEQ ID NO: 317 - DNA, 20 bp, Artificial Sequence
  Synthetic oligonucleotide
cagcaaggagactgtgctga

SEQ ID NO: 318 - DNA, 22 bp, Artificial Sequence
  Synthetic oligonucleotide
ggtcctcttctccacggtagat

SEQ ID NO: 319 - DNA, 24 bp, Artificial Sequence
  Synthetic oligonucleotide
ctcctggatggccaaatttgatgc

SEQ ID NO: 320 - DNA, 68 bp, Artificial Sequence
  Synthetic oligonucleotide
cagcaaggagactgtgctgagctcctggatggccaaatttgatgccatctaccgtggagaagaggacc

SEQ ID NO: 321 - DNA, 20 bp, Artificial Sequence
  Synthetic oligonucleotide
aactggagctgaggttgaca

SEQ ID NO: 322 - DNA, 20 bp, Artificial Sequence
  Synthetic oligonucleotide
catctacgctgtaccccaga

SEQ ID NO: 323 - DNA, 25 bp, Artificial Sequence
  Synthetic oligonucleotide
tcacaggcatgacaatgctgctaca

SEQ ID NO: 324 - DNA, 68 bp, Artificial Sequence
  Synthetic oligonucleotide
aactggagctgaggttgacatcacaggcatgacaatgctgctacaaaatctggggtacagcgtagatg

SEQ ID NO: 325 - DNA, 21 bp, Artificial Sequence
  Synthetic oligonucleotide
tgagcctgagcagagacatga

SEQ ID NO: 326 - DNA, 18 bp, Artificial Sequence
  Synthetic oligonucleotide
ccttcctgcgtggtccat

SEQ ID NO: 327 - DNA, 25 bp, Artificial Sequence
  Synthetic oligonucleotide
tcagcctgttccatgaaggcagagc

SEQ ID NO: 328 - DNA, 66 bp, Artificial Sequence
  Synthetic oligonucleotide
tgagcctgagcagagacatgactcagcctgttccatgaaggcagagccatggaccacgcaggaagg

SEQ ID NO: 329 - DNA, 18 bp, Artificial Sequence
  Synthetic oligonucleotide
gcagcgccgagactttta

SEQ ID NO: 330 - DNA, 19 bp, Artificial Sequence
  Synthetic oligonucleotide
agtctctctccgtcgctcc

SEQ ID NO: 331 - DNA, 23 bp, Artificial Sequence
  Synthetic oligonucleotide
ctttcgctaaaggggccccagac

SEQ ID NO: 332 - DNA, 75 bp, Artificial Sequence
  Synthetic oligonucleotide
gcagcgccgagacttttagtttcgctttcgctaaaggggccccagacccttgctgcggagcgacggagagagact

SEQ ID NO: 333 - DNA, 20 bp, Artificial Sequence
  Synthetic oligonucleotide
gtggctcaacattgtgttcc

SEQ ID NO: 334 - DNA, 20 bp, Artificial Sequence
  Synthetic oligonucleotide
caatggcctccattttacag

SEQ ID NO: 335 - DNA, 24 bp, Artificial Sequence
  Synthetic oligonucleotide
atttcagctgatcagtgggcctcc

SEQ ID NO: 336 - DNA, 74 bp, Artificial Sequence
  Synthetic oligonucleotide
gtggctcaacattgtgttcccatttcagctgatcagtgggcctccaaggaggggctgtaaaatggaggccattg

SEQ ID NO: 337 - DNA, 18 bp, Artificial Sequence
  Synthetic oligonucleotide
cttccctgggacgacttg

SEQ ID NO: 338 - DNA, 19 bp, Artificial Sequence
  Synthetic oligonucleotide
ctcctggtcacccttctgg

SEQ ID NO: 339 - DNA, 24 bp, Artificial Sequence
  Synthetic oligonucleotide
cccgtactgtcatgcctcagagct

SEQ ID NO: 340 - DNA, 66 bp, Artificial Sequence
  Synthetic oligonucleotide
cttccctgggacgacttgccagctctgaggcatgacagtacgggcccccagaagggtgaccaggag

SEQ ID NO: 341 - DNA, 19 bp, Artificial Sequence
  Synthetic oligonucleotide
cgctcagccagatgcaatc

SEQ ID NO: 342 - DNA, 25 bp, Artificial Sequence
  Synthetic oligonucleotide
gcactgagatcttcctattggtgaa

SEQ ID NO: 343 - DNA, 21 bp, Artificial Sequence
  Synthetic oligonucleotide
tgccccagtcacctgctgtta

SEQ ID NO: 344 - DNA, 71 bp, Artificial Sequence
  Synthetic oligonucleotide
cgctcagccagatgcaatcaatgccccagtcacctgctgttataacttcaccaataggaagatctcagtgc

SEQ ID NO: 345 - DNA, 20 bp, Artificial Sequence
  Synthetic oligonucleotide
aggttctgagctctggcttt

SEQ ID NO: 346 - DNA, 20 bp, Artificial Sequence
  Synthetic oligonucleotide
atgctgacttccttcctggt

SEQ ID NO: 347 - DNA, 22 bp, Artificial Sequence
  Synthetic oligonucleotide
acagagccctggcaaagccaag

SEQ ID NO: 348 - DNA, 65 bp, Artificial Sequence
  Synthetic oligonucleotide
aggttctgagctctggctttgccttggctttgccagggctctgtgaccaggaaggaagtcagcat

SEQ ID NO: 349 - DNA, 20 bp, Artificial Sequence
  Synthetic oligonucleotide
ttcaggttgttgcaggagac

SEQ ID NO: 350 - DNA, 20 bp, Artificial Sequence
  Synthetic oligonucleotide
catcttcttgggcacacaat

SEQ ID NO: 351 - DNA, 27 bp, Artificial Sequence
  Synthetic oligonucleotide
tgtctccattattgatcggttcatgca

SEQ ID NO: 352 - DNA, 84 bp, Artificial Sequence
  Synthetic oligonucleotide
ttcaggttgttgcaggagaccatgtacatgactgtctccattattgatcggttcatgcagaataattgtgtgcccaagaagatg

SEQ ID NO: 353 - DNA, 21 bp, Artificial Sequence
  Synthetic oligonucleotide
gcatgttcgtggcctctaaga

SEQ ID NO: 354 - DNA, 22 bp, Artificial Sequence
  Synthetic oligonucleotide
cggtgtagatgcacagcttctc

SEQ ID NO: 355 - DNA, 23 bp, Artificial Sequence
  Synthetic oligonucleotide
aaggagaccatccccctgacggc

SEQ ID NO: 356 - DNA, 69 bp, Artificial Sequence
  Synthetic oligonucleotide
gcatgttcgtggcctctaagatgaaggagaccatccccctgacggccgagaagctgtgcatctacaccg

SEQ ID NO: 357 - DNA, 22 bp, Artificial Sequence
  Synthetic oligonucleotide
atgctgtggctccttcctaact

SEQ ID NO: 358 - DNA, 27 bp, Artificial Sequence
  Synthetic oligonucleotide
acccaaattgtgatatacaaaaaggtt

SEQ ID NO: 359 - DNA, 30 bp, Artificial Sequence
  Synthetic oligonucleotide
taccaagcaacctacatgtcaagaaagccc

SEQ ID NO: 360 - DNA, 82 bp, Artificial Sequence
  Synthetic oligonucleotide
atgctgtggctccttcctaactggggctttcttgacatgtaggttgcttggtaataacctttttgtatatcacaatttgggt

SEQ ID NO: 361 - DNA, 19 bp, Artificial Sequence
  Synthetic oligonucleotide
gagatcttcggtgggggta

SEQ ID NO: 362 - DNA, 20 bp, Artificial Sequence
  Synthetic oligonucleotide
ctgcagacgagaacccaaac

SEQ ID NO: 363 - DNA, 24 bp, Artificial Sequence
  Synthetic oligonucleotide
catcagcgtcctggcgtaaaacac

SEQ ID NO: 364 - DNA, 67 bp, Artificial Sequence
  Synthetic oligonucleotide
gagatcttcggtgggggtacgggtgttttacgccaggacgctgatgcgtttgggttctcgtctgcag

SEQ ID NO: 365 - DNA, 18 bp, Artificial Sequence
  Synthetic oligonucleotide
tccaagacccaatgggaa

SEQ ID NO: 366 - DNA, 19 bp, Artificial Sequence
  Synthetic oligonucleotide
tcgtaggctttcgtgagga

SEQ ID NO: 367 - DNA, 24 bp, Artificial Sequence
  Synthetic oligonucleotide
actcaccacacctgcagccttcac

SEQ ID NO: 368 - DNA, 66 bp, Artificial Sequence
  Synthetic oligonucleotide
tccaagacccaatgggaattcactcaccacacctgcagccttcactttcctcacgaaagcctacga

SEQ ID NO: 369 - DNA, 21 bp, Artificial Sequence
  Synthetic oligonucleotide
caacctgtgcgaaagtctacc

SEQ ID NO: 370 - DNA, 20 bp, Artificial Sequence
  Synthetic oligonucleotide
acacccaagaccaggacaat

SEQ ID NO: 371 - DNA, 24 bp, Artificial Sequence
  Synthetic oligonucleotide
cctccaatgaaactggctgcatca

SEQ ID NO: 372 - DNA, 68 bp, Artificial Sequence
  Synthetic oligonucleotide
caacctgtgcgaaagtctacctttgatgcagccagtttcattggaggaattgtcctggtcttgggtgt

SEQ ID NO: 373 - DNA, 20 bp, Artificial Sequence
  Synthetic oligonucleotide
ggagtggaaggaactggaaa

SEQ ID NO: 374 - DNA, 20 bp, Artificial Sequence
  Synthetic oligonucleotide
tcatgggcgtatctacgaat

SEQ ID NO: 375 - DNA, 22 bp, Artificial Sequence
  Synthetic oligonucleotide
cgcaccattcggtcatttgagg

SEQ ID NO: 376 - DNA, 78 bp, Artificial Sequence
  Synthetic oligonucleotide
ggagtggaaggaactggaaacattattccgtatacgcaccattcggtcatttgagggaattcgtagatacgcccatga

SEQ ID NO: 377 - DNA, 20 bp, Artificial Sequence
  Synthetic oligonucleotide
ccaaaggatgcgatacacag

SEQ ID NO: 378 - DNA, 21 bp, Artificial Sequence
  Synthetic oligonucleotide
ggatgacttgggaatcatgtc

SEQ ID NO: 379 - DNA, 27 bp, Artificial Sequence
  Synthetic oligonucleotide
ccactgtgcagccttatttctccaatg

SEQ ID NO: 380 - DNA, 69 bp, Artificial Sequence
  Synthetic oligonucleotide
ccaaaggatgcgatacacagaccactgtgcagccttatttctccaatggacatgattcccaagtcatcc

SEQ ID NO: 381 - DNA, 20 bp, Artificial Sequence
  Synthetic oligonucleotide
ggcaccactgcttatgaagg

SEQ ID NO: 382 - DNA, 20 bp, Artificial Sequence
  Synthetic oligonucleotide
gatgctcatggtgaatgagg

SEQ ID NO: 383 - DNA, 24 bp, Artificial Sequence
  Synthetic oligonucleotide
actggaacccagaagcacaccctc

SEQ ID NO: 384 - DNA, 67 bp, Artificial Sequence
  Synthetic oligonucleotide
ggcaccactgcttatgaaggaaactggaacccagaagcacaccctcccctcattcaccatgagcatc

SEQ ID NO: 385 - DNA, 18 bp, Artificial Sequence
  Synthetic oligonucleotide
tggttcccagccctgtgt

SEQ ID NO: 386 - DNA, 19 bp, Artificial Sequence
  Synthetic oligonucleotide
ctcctccaccctgggttgt

SEQ ID NO: 387 - DNA, 28 bp, Artificial Sequence
  Synthetic oligonucleotide
ctccaagcccagattcagattcgagtca

SEQ ID NO: 388 - DNA, 74 bp, Artificial Sequence
  Synthetic oligonucleotide
tggttcccagccctgtgtccacctccaagcccagattcagattcgagtcatgtacacaacccagggtggaggag

SEQ ID NO: 389 - DNA, 20 bp, Artificial Sequence
  Synthetic oligonucleotide
gtgcaggctcaggtgaagtg

SEQ ID NO: 390 - DNA, 20 bp, Artificial Sequence
  Synthetic oligonucleotide
gacctcagggcgattcatga

SEQ ID NO: 391 - DNA, 30 bp, Artificial Sequence
  Synthetic oligonucleotide
tcagcttctacaactggacagacaacgctg

SEQ ID NO: 392 - DNA, 84 bp, Artificial Sequence
  Synthetic oligonucleotide
gtgcaggctcaggtgaagtgctgcggctgggtcagcttctacaactggacagacaacgctgagctcatgaatcgccctgaggtc

SEQ ID NO: 393 - DNA, 21 bp, Artificial Sequence
  Synthetic oligonucleotide
tggattggagttctgggaatg

SEQ ID NO: 394 - DNA, 22 bp, Artificial Sequence
  Synthetic oligonucleotide
gcttgcactccacaggtacaca

SEQ ID NO: 395 - DNA, 23 bp, Artificial Sequence
  Synthetic oligonucleotide
actggccgtggcactggacaaca

SEQ ID NO: 396 - DNA, 68 bp, Artificial Sequence
  Synthetic oligonucleotide
tggattggagttctgggaatgtactggccgtggcactggacaacagtgtgtacctgtggagtgcaagc

SEQ ID NO: 397 - DNA, 18 bp, Artificial Sequence
  Synthetic oligonucleotide
gctgcaggaccagtgagg

SEQ ID NO: 398 - DNA, 18 bp, Artificial Sequence
  Synthetic oligonucleotide
tagggcagctggcttcag

SEQ ID NO: 399 - DNA, 24 bp, Artificial Sequence
  Synthetic oligonucleotide
ctgctacctcccttgcctttcgag

SEQ ID NO: 400 - DNA, 76 bp, Artificial Sequence
  Synthetic oligonucleotide
gctgcaggaccagtgaggggcctgcgccagtcctgctacctcccttgcctttcgaggcctgaagccagctgcccta

SEQ ID NO: 401 - DNA, 21 bp, Artificial Sequence
  Synthetic oligonucleotide
gcaacactccccatttacctc

SEQ ID NO: 402 - DNA, 20 bp, Artificial Sequence
  Synthetic oligonucleotide
tgagggggaccattctcttt

SEQ ID NO: 403 - DNA, 24 bp, Artificial Sequence
  Synthetic oligonucleotide
ttgttctccaccaaagcaaggcaa

SEQ ID NO: 404 - DNA, 67 bp, Artificial Sequence
  Synthetic oligonucleotide
gcaacactccccatttacctccttgttctccaccaaagcaaggcaagaaagagaatggtccccctca

SEQ ID NO: 405 - DNA, 21 bp, Artificial Sequence
  Synthetic oligonucleotide
tgagtgtcccccggtatcttc

SEQ ID NO: 406 - DNA, 21 bp, Artificial Sequence
  Synthetic oligonucleotide
cagccgctttcagattttcat

SEQ ID NO: 407 - DNA, 27 bp, Artificial Sequence
  Synthetic oligonucleotide
tgccaatcccgatgaaattggaaattt

SEQ ID NO: 408 - DNA, 81 bp, Artificial Sequence
  Synthetic oligonucleotide
tgagtgtcccccggtatcttccccgccctgccaatcccgatgaaattggaaattttattgatgaaaatctgaaagcggctg

SEQ ID NO: 409 - DNA, 21 bp, Artificial Sequence
  Synthetic oligonucleotide
tgtggtgcaagtcacagctac

SEQ ID NO: 410 - DNA, 20 bp, Artificial Sequence
  Synthetic oligonucleotide
tgtaaatgactctggcgctg

SEQ ID NO: 411 - DNA, 24 bp, Artificial Sequence
  Synthetic oligonucleotide
atgccgatgacccttcatatggga

SEQ ID NO: 412 - DNA, 68 bp, Artificial Sequence
  Synthetic oligonucleotide
tgtggtgcaagtcacagctacagatgccgatgacccttcatatgggaacagcgccagagtcatttaca

SEQ ID NO: 413 - DNA, 18 bp, Artificial Sequence
  Synthetic oligonucleotide
gtcggcagaagcaggact

SEQ ID NO: 414 - DNA, 18 bp, Artificial Sequence
  Synthetic oligonucleotide
ctactcatgggcgggatg

SEQ ID NO: 415 - DNA, 24 bp, Artificial Sequence
  Synthetic oligonucleotide
ccttctgcccatagtgatcagcga

SEQ ID NO: 416 - DNA, 70 bp, Artificial Sequence
  Synthetic oligonucleotide
gtcggcagaagcaggacttgtaccttctgcccatagtgatcagcgatggcggcatcccgcccatgagtag

SEQ ID NO: 417 - DNA, 20 bp, Artificial Sequence
  Synthetic oligonucleotide
agtaccataatgcgggaacg

SEQ ID NO: 418 - DNA, 22 bp, Artificial Sequence
  Synthetic oligonucleotide
agactgcctgtataggctcctg

SEQ ID NO: 419 - DNA, 24 bp, Artificial Sequence
  Synthetic oligonucleotide
actcggaaaaccacaagcgctgag

SEQ ID NO: 420 - DNA, 72 bp, Artificial Sequence
  Synthetic oligonucleotide
agtaccataatgcgggaacgcaagactcggaaaaccacaagcgctgagatcaggagcctatacaggcagtct

SEQ ID NO: 421 - DNA, 18 bp, Artificial Sequence
  Synthetic oligonucleotide
acaggagacgtgttcgcc

SEQ ID NO: 422 - DNA, 22 bp, Artificial Sequence
  Synthetic oligonucleotide
cagcagtgaggtggtactctga

SEQ ID NO: 423 - DNA, 24 bp, Artificial Sequence
  Synthetic oligonucleotide
tattctcccggtccagcctctcaa

SEQ ID NO: 424 - DNA, 67 bp, Artificial Sequence
  Synthetic oligonucleotide
acaggagacgtgttcgccattgagaggctggaccgggagaatatctcagagtaccacctcactgctg

SEQ ID NO: 425 - DNA, 20 bp, Artificial Sequence
  Synthetic oligonucleotide
gtttgacatggctgcactga

SEQ ID NO: 426 - DNA, 18 bp, Artificial Sequence
  Synthetic oligonucleotide
agtcacatccctccgggt

SEQ ID NO: 427 - DNA, 24 bp, Artificial Sequence
  Synthetic oligonucleotide
acctcaacgtcatccgagacacca

SEQ ID NO: 428 - DNA, 67 bp, Artificial Sequence
  Synthetic oligonucleotide
gtttgacatggctgcactgagaaacctcaacgtcatccgagacaccaagacccggagggatgtgact

SEQ ID NO: 429 - DNA, 21 bp, Artificial Sequence
  Synthetic oligonucleotide
gcaaggtaaatgggaagttgg

SEQ ID NO: 430 - DNA, 22 bp, Artificial Sequence
  Synthetic oligonucleotide
gatagctgtgaaaggtgtccct

SEQ ID NO: 431 - DNA, 24 bp, Artificial Sequence
  Synthetic oligonucleotide
cttcctgcagcctgatcaccttca

SEQ ID NO: 432 - DNA, 77 bp, Artificial Sequence
  Synthetic oligonucleotide
gcaaggtaaatgggaagttggtagctctgaaggtgatcaggctgcaggaagaagaagggacacctttcacagctatc

SEQ ID NO: 433 - DNA, 20 bp, Artificial Sequence
  Synthetic oligonucleotide
aatgctgcactacgacccta

SEQ ID NO: 434 - DNA, 20 bp, Artificial Sequence
  Synthetic oligonucleotide
ttggtcacatcctggaagaa

SEQ ID NO: 435 - DNA, 21 bp, Artificial Sequence
  Synthetic oligonucleotide
ccttggccgaaatccgcttgt

SEQ ID NO: 436 - DNA, 78 bp, Artificial Sequence
  Synthetic oligonucleotide
aatgctgcactacgaccctaacaagcggatttcggccaaggcagccctggctcaccctttcttccaggatgtgaccaa

SEQ ID NO: 437 - DNA, 19 bp, Artificial Sequence
  Synthetic oligonucleotide
ccaggaagggactggaaga

SEQ ID NO: 438 - DNA, 18 bp, Artificial Sequence
  Synthetic oligonucleotide
gttgcatgagcaggtccc

SEQ ID NO: 439 - DNA, 24 bp, Artificial Sequence
  Synthetic oligonucleotide
ctctggctccagattgggcacaat

SEQ ID NO: 440 - DNA, 66 bp, Artificial Sequence
  Synthetic oligonucleotide
ccaggaagggactggaagagattgtgcccaatctggagccagagggcagggacctgctcatgcaac

SEQ ID NO: 441 - DNA, 19 bp, Artificial Sequence
  Synthetic oligonucleotide
gtctcgggcaaagcgttat

SEQ ID NO: 442 - DNA, 20 bp, Artificial Sequence
  Synthetic oligonucleotide
ctctggccttgtaaacggtg

SEQ ID NO: 443 - DNA, 24 bp, Artificial Sequence
  Synthetic oligonucleotide
cctccccaaggaagtccagcttct

SEQ ID NO: 444 - DNA, 74 bp, Artificial Sequence
  Synthetic oligonucleotide
gtctcgggcaaagcgttatgagaagctggacttccttggggagggacagtttgccaccgtttacaaggccagag

SEQ ID NO: 445 - DNA, 21 bp, Artificial Sequence
  Synthetic oligonucleotide
tggagactctcagggtcgaaa

SEQ ID NO: 446 - DNA, 22 bp, Artificial Sequence
  Synthetic oligonucleotide
ggcgtttggagtggtagaaatc

SEQ ID NO: 447 - DNA, 20 bp, Artificial Sequence
  Synthetic oligonucleotide
cggcggcagaccagcatgac

SEQ ID NO: 448 - DNA, 65 bp, Artificial Sequence
  Synthetic oligonucleotide
tggagactctcagggtcgaaaacggcggcagaccagcatgacagatttctaccactccaaacgcc

SEQ ID NO: 449 - DNA, 18 bp, Artificial Sequence
  Synthetic oligonucleotide
cggcgatcaagaagctgt

SEQ ID NO: 450 - DNA, 18 bp, Artificial Sequence
  Synthetic oligonucleotide
caggcgctgatctcttgc

SEQ ID NO: 451 - DNA, 24 bp, Artificial Sequence
  Synthetic oligonucleotide
cgggcctctgatctccgatttctt

SEQ ID NO: 452 - DNA, 69 bp, Artificial Sequence
  Synthetic oligonucleotide
cggcgatcaagaagctgtccgggcctctgatctccgatttcttcgccaagcgcaagagatcagcgcctg

SEQ ID NO: 453 - DNA, 18 bp, Artificial Sequence
  Synthetic oligonucleotide
gacgctgcagagcacctt

SEQ ID NO: 454 - DNA, 19 bp, Artificial Sequence
  Synthetic oligonucleotide
gcgggaatctctcctcagt

SEQ ID NO: 455 - DNA, 24 bp, Artificial Sequence
  Synthetic oligonucleotide
cacaggatgctggcctttgctctt

SEQ ID NO: 456 - DNA, 68 bp, Artificial Sequence
  Synthetic oligonucleotide
gacgctgcagagcacctttgcacaggatgctggcctttgctcttactacactgaggagagattcccgc

SEQ ID NO: 457 - DNA, 20 bp, Artificial Sequence
  Synthetic oligonucleotide
gagcactgggcaatcgttac

SEQ ID NO: 458 - DNA, 19 bp, Artificial Sequence
  Synthetic oligonucleotide
caaaggcgaacgggagtag

SEQ ID NO: 459 - DNA, 24 bp, Artificial Sequence
  Synthetic oligonucleotide
cctgtaacttgagggccaccgaac

SEQ ID NO: 460 - DNA, 67 bp, Artificial Sequence
  Synthetic oligonucleotide
gagcactgggcaatcgttacgacctgtaacttgagggccaccgaactgctactcccgttcgcctttg

SEQ ID NO: 461 - DNA, 21 bp, Artificial Sequence
  Synthetic oligonucleotide
tggatctctaccagcaatgtg

SEQ ID NO: 462 - DNA, 20 bp, Artificial Sequence
  Synthetic oligonucleotide
atgtcaggagtccctccatc

SEQ ID NO: 463 - DNA, 24 bp, Artificial Sequence
  Synthetic oligonucleotide
atcacccatcatcatccaatcgca

SEQ ID NO: 464 - DNA, 70 bp, Artificial Sequence
  Synthetic oligonucleotide
tggatctctaccagcaatgtggaattatcacccatcatcatccaatcgcagatggagggactcctgacat

SEQ ID NO: 465 - DNA, 20 bp, Artificial Sequence
  Synthetic oligonucleotide
gggcttctttgctactgtgg

SEQ ID NO: 466 - DNA, 20 bp, Artificial Sequence
  Synthetic oligonucleotide
acagggcagacaaagcatct

SEQ ID NO: 467 - DNA, 24 bp, Artificial Sequence
  Synthetic oligonucleotide
cccggacatcacataggacagcag

SEQ ID NO: 468 - DNA, 78 bp, Artificial Sequence
  Synthetic oligonucleotide
gggcttctttgctactgtggtgtttggccttctgctgtcctatgtgatgtccgggtacagatgctttgtctgccctgt

SEQ ID NO: 469 - DNA, 18 bp, Artificial Sequence
  Synthetic oligonucleotide
ctcccgtcaacagcgttc

SEQ ID NO: 470 - DNA, 18 bp, Artificial Sequence
  Synthetic oligonucleotide
gggtgagtctggccttca

SEQ ID NO: 471 - DNA, 24 bp, Artificial Sequence
  Synthetic oligonucleotide
acactggaccaggagtgcatccag

SEQ ID NO: 472 - DNA, 68 bp, Artificial Sequence
  Synthetic oligonucleotide
ctcccgtcaacagcgttctttccaaacactggaccaggagtgcatccagatgaaggccagactcaccc

SEQ ID NO: 473 - DNA, 22 bp, Artificial Sequence
  Synthetic oligonucleotide
gaactcagtgtatgagaagcgg

SEQ ID NO: 474 - DNA, 18 bp, Artificial Sequence
  Synthetic oligonucleotide
gctctgtagcacctgcgg

SEQ ID NO: 475 - DNA, 24 bp, Artificial Sequence
  Synthetic oligonucleotide
tgcacgtaccagcacatcctgaag

SEQ ID NO: 476 - DNA, 70 bp, Artificial Sequence
  Synthetic oligonucleotide
gaactcagtgtatgagaagcggcctgacttcaggatgtgctggtacgtgcacccgcaggtgctacagagc

SEQ ID NO: 477 - DNA, 19 bp, Artificial Sequence
  Synthetic oligonucleotide
ttacgacgctcgtgaaagc

SEQ ID NO: 478 - DNA, 20 bp, Artificial Sequence
  Synthetic oligonucleotide
tctccctgatgcacatgtct

SEQ ID NO: 479 - DNA, 24 bp, Artificial Sequence
  Synthetic oligonucleotide
ccaccattggccgcttagtggtat

SEQ ID NO: 480 - DNA, 66 bp, Artificial Sequence
  Synthetic oligonucleotide
ttacgacgctcgtgaaagcacataccactaagcggccaatggtggtagacatgtgcatcagggaga

SEQ ID NO: 481 - DNA, 18 bp, Artificial Sequence
  Synthetic oligonucleotide
tctcgctgcctctatccc

SEQ ID NO: 482 - DNA, 18 bp, Artificial Sequence
  Synthetic oligonucleotide
cctggttgatgctggaca

SEQ ID NO: 483 - DNA, 24 bp, Artificial Sequence
  Synthetic oligonucleotide
atccgggtcatcatgaagagctcc

SEQ ID NO: 484 - DNA, 69 bp, Artificial Sequence
  Synthetic oligonucleotide
tctcgctgcctctatcccgcatccgggtcatcatgaagagctcccccgaggtgtccagcatcaaccagg

SEQ ID NO: 485 - DNA, 20 bp, Artificial Sequence
  Synthetic oligonucleotide
ggctggacgtggttttgtct

SEQ ID NO: 486 - DNA, 20 bp, Artificial Sequence
  Synthetic oligonucleotide
cgctgcagaaaatgaaacga

SEQ ID NO: 487 - DNA, 18 bp, Artificial Sequence
  Synthetic oligonucleotide
ctgcgcccgctcttcgcg

SEQ ID NO: 488 - DNA, 62 bp, Artificial Sequence
  Synthetic oligonucleotide
ggctggacgtggttttgtctgctgcgcccgctcttcgcgctctcgtttcattttctgcagcg

SEQ ID NO: 489 - DNA, 18 bp, Artificial Sequence
  Synthetic oligonucleotide
accaactgcgtgcaggac

SEQ ID NO: 490 - DNA, 18 bp, Artificial Sequence
  Synthetic oligonucleotide
ggcgagaaggaacagcac

SEQ ID NO: 491 - DNA, 23 bp, Artificial Sequence
  Synthetic oligonucleotide
caaggccaagatcaccatcgtgg

SEQ ID NO: 492 - DNA, 72 bp, Artificial Sequence
  Synthetic oligonucleotide
accaactgcgtgcaggacgacacggccaaggccaagatcaccatcgtggcaggcgtgctgttccttctcgcc

SEQ ID NO: 493 - DNA, 19 bp, Artificial Sequence
  Synthetic oligonucleotide
accgtatggacagccacag

SEQ ID NO: 494 - DNA, 21 bp, Artificial Sequence
  Synthetic oligonucleotide
tgactacaggatcagcgcttc

SEQ ID NO: 495 - DNA, 24 bp, Artificial Sequence
  Synthetic oligonucleotide
tctcacatgctgtacccaaagcca

SEQ ID NO: 496 - DNA, 67 bp, Artificial Sequence
  Synthetic oligonucleotide
accgtatggacagccacagcctggctttgggtacagcatgtgagatgaagcgctgatcctgtagtca

SEQ ID NO: 497 - DNA, 18 bp, Artificial Sequence
  Synthetic oligonucleotide
gcccaagaggggaagatg

SEQ ID NO: 498 - DNA, 19 bp, Artificial Sequence
  Synthetic oligonucleotide
ggacctgggtctccagttg

SEQ ID NO: 499 - DNA, 24 bp, Artificial Sequence
  Synthetic oligonucleotide
ctgctcgacctttgggtccttcag

SEQ ID NO: 500 - DNA, 67 bp, Artificial Sequence
  Synthetic oligonucleotide
gcccaagaggggaagatggccctgaaggacccaaaggtcgagcaggcccaactggagacccaggtcc

SEQ ID NO: 501 - DNA, 18 bp, Artificial Sequence
  Synthetic oligonucleotide
gtggccatccagctgacc

SEQ ID NO: 502 - DNA, 23 bp, Artificial Sequence
  Synthetic oligonucleotide
cagtggtaggtgatgttctggga

SEQ ID NO: 503 - DNA, 21 bp, Artificial Sequence
  Synthetic oligonucleotide
tcctgcgcctgatgtccaccg

SEQ ID NO: 504 - DNA, 68 bp, Artificial Sequence
  Synthetic oligonucleotide
gtggccatccagctgaccttcctgcgcctgatgtccaccgaggcctcccagaacatcacctaccactg

SEQ ID NO: 505 - DNA, 24 bp, Artificial Sequence
  Synthetic oligonucleotide
cagccaagaactggtataggagct

SEQ ID NO: 506 - DNA, 19 bp, Artificial Sequence
  Synthetic oligonucleotide
aaactggctgccagcattg

SEQ ID NO: 507 - DNA, 30 bp, Artificial Sequence
  Synthetic oligonucleotide
tctcctagccagacgtgtttcttgtccttg

SEQ ID NO: 508 - DNA, 80 bp, Artificial Sequence
  Synthetic oligonucleotide
cagccaagaactggtataggagctccaaggacaagaaacacgtctggctaggagaaactatcaatgctggcagccagttt

SEQ ID NO: 509 - DNA, 19 bp, Artificial Sequence
  Synthetic oligonucleotide
ggaggttctggacctgctg

SEQ ID NO: 510 - DNA, 18 bp, Artificial Sequence
  Synthetic oligonucleotide
accaggactgccacgttc

SEQ ID NO: 511 - DNA, 24 bp, Artificial Sequence
  Synthetic oligonucleotide
ctcctggtccccaaggtgtcaaag

SEQ ID NO: 512 - DNA, 66 bp, Artificial Sequence
  Synthetic oligonucleotide
ggaggttctggacctgctggtcctcctggtccccaaggtgtcaaaggtgaacgtggcagtcctggt

SEQ ID NO: 513 - DNA, 18 bp, Artificial Sequence
  Synthetic oligonucleotide
acaaaggcctcccaggat

SEQ ID NO: 514 - DNA, 20 bp, Artificial Sequence
  Synthetic oligonucleotide
gagtcccaggaagacctgct

SEQ ID NO: 515 - DNA, 24 bp, Artificial Sequence
  Synthetic oligonucleotide
ctcctttgacaccagggatgccat

SEQ ID NO: 516 - DNA, 66 bp, Artificial Sequence
  Synthetic oligonucleotide
acaaaggcctcccaggattggatggcatccctggtgtcaaaggagaagcaggtcttcctgggactc

SEQ ID NO: 517 - DNA, 18 bp, Artificial Sequence
  Synthetic oligonucleotide
ctccctgggaaagatggc

SEQ ID NO: 518 - DNA, 18 bp, Artificial Sequence
  Synthetic oligonucleotide
ctggaccaggaagccctc

SEQ ID NO: 519 - DNA, 24 bp, Artificial Sequence
  Synthetic oligonucleotide
ccagggaaaccacgtaatcctgga

SEQ ID NO: 520 - DNA, 67 bp, Artificial Sequence
  Synthetic oligonucleotide
ctccctgggaaagatggccctccaggattacgtggtttccctggggaccgagggcttcctggtccag

SEQ ID NO: 521 - DNA, 18 bp, Artificial Sequence
  Synthetic oligonucleotide
ggtcgaggaacccaaggt

SEQ ID NO: 522 - DNA, 19 bp, Artificial Sequence
  Synthetic oligonucleotide
gcctggaggtccaactctg

SEQ ID NO: 523 - DNA, 24 bp, Artificial Sequence
  Synthetic oligonucleotide
ccaggaaatcctgtagcaccaggc

SEQ ID NO: 524 - DNA, 72 bp, Artificial Sequence
  Synthetic oligonucleotide
ggtcgaggaacccaaggtccgcctggtgctacaggatttcctggttctgcgggcagagttggacctccaggc

SEQ ID NO: 525 - DNA, 19 bp, Artificial Sequence
  Synthetic oligonucleotide
ggagaccctggtgaagctg

SEQ ID NO: 526 - DNA, 18 bp, Artificial Sequence
  Synthetic oligonucleotide
tctccagggacaccaacg

SEQ ID NO: 527 - DNA, 24 bp, Artificial Sequence
  Synthetic oligonucleotide
cttctcttccctgatcaccctgcg

SEQ ID NO: 528 - DNA, 68 bp, Artificial Sequence
  Synthetic oligonucleotide
ggagaccctggtgaagctggcccgcagggtgatcagggaagagaaggccccgttggtgtccctggaga

SEQ ID NO: 529 - DNA, 21 bp, Artificial Sequence
  Synthetic oligonucleotide
gagagcaagcgagacattctg

SEQ ID NO: 530 - DNA, 18 bp, Artificial Sequence
  Synthetic oligonucleotide
aacagggaactggcccac

SEQ ID NO: 531 - DNA, 24 bp, Artificial Sequence
  Synthetic oligonucleotide
cctctttgacggctcagccaatct

SEQ ID NO: 532 - DNA, 66 bp, Artificial Sequence
  Synthetic oligonucleotide
gagagcaagcgagacattctgttcctctttgacggctcagccaatcttgtgggccagttccctgtt

SEQ ID NO: 533 - DNA, 18 bp, Artificial Sequence
  Synthetic oligonucleotide
tggtgttccagggcttct

SEQ ID NO: 534 - DNA, 19 bp, Artificial Sequence
  Synthetic oligonucleotide
ccctgtaaaccctgatccc

SEQ ID NO: 535 - DNA, 24 bp, Artificial Sequence
  Synthetic oligonucleotide
cctaagggagagccaggaatccca

SEQ ID NO: 536 - DNA, 66 bp, Artificial Sequence
  Synthetic oligonucleotide
tggtgttccagggcttctcggacctaagggagagccaggaatcccaggggatcagggtttacaggg

SEQ ID NO: 537 - DNA, 18 bp, Artificial Sequence
  Synthetic oligonucleotide
gggaaccatccagggtct

SEQ ID NO: 538 - DNA, 18 bp, Artificial Sequence
  Synthetic oligonucleotide
attccgggtggacagttg

SEQ ID NO: 539 - DNA, 24 bp, Artificial Sequence
  Synthetic oligonucleotide
acacaggaaatccgcactgccttc

SEQ ID NO: 540 - DNA, 66 bp, Artificial Sequence
  Synthetic oligonucleotide
gggaaccatccagggtctggaaggcagtgcggatttcctgtgtccaaccaactgtccacccggaat

SEQ ID NO: 541 - DNA, 21 bp, Artificial Sequence
  Synthetic oligonucleotide
tcccttatgaacaaggagcac

SEQ ID NO: 542 - DNA, 21 bp, Artificial Sequence
  Synthetic oligonucleotide
aaccattggtgcatagtccat

SEQ ID NO: 543 - DNA, 24 bp, Artificial Sequence
  Synthetic oligonucleotide
tgccagttgcccagataactgtga

SEQ ID NO: 544 - DNA, 72 bp, Artificial Sequence
  Synthetic oligonucleotide
tcccttatgaacaaggagcaccttgtgccagttgcccagataactgtgacgatggactatgcaccaatggtt

SEQ ID NO: 545 - DNA, 18 bp, Artificial Sequence
  Synthetic oligonucleotide
tgcagcggctgattgaca

SEQ ID NO: 546 - DNA, 25 bp, Artificial Sequence
  Synthetic oligonucleotide
caactgttcctggtctacaaactca

SEQ ID NO: 547 - DNA, 28 bp, Artificial Sequence
  Synthetic oligonucleotide
tcagatggagacctcgtgccaaattaca

SEQ ID NO: 548 - DNA, 74 bp, Artificial Sequence
  Synthetic oligonucleotide
tgcagcggctgattgacagtcagatggagacctcgtgccaaattacatttgagtttgtagaccaggaacagttg

SEQ ID NO: 549 - DNA, 20 bp, Artificial Sequence
  Synthetic oligonucleotide
cctgaacatgaaggagctga

SEQ ID NO: 550 - DNA, 19 bp, Artificial Sequence
  Synthetic oligonucleotide
catcacgtctccgaactcc

SEQ ID NO: 551 - DNA, 21 bp, Artificial Sequence
  Synthetic oligonucleotide
tcccgatggtctgcagcagct

SEQ ID NO: 552 - DNA, 64 bp, Artificial Sequence
  Synthetic oligonucleotide
cctgaacatgaaggagctgaagctgctgcagaccatcgggaagggggagttcggagacgtgatg

SEQ ID NO: 553 - DNA, 18 bp, Artificial Sequence
  Synthetic oligonucleotide
acccaagaccctgcctct

SEQ ID NO: 554 - DNA, 18 bp, Artificial Sequence
  Synthetic oligonucleotide
gcaggggtggagtgatgt

SEQ ID NO: 555 - DNA, 24 bp, Artificial Sequence
  Synthetic oligonucleotide
ccacccttctccagggacccttag

SEQ ID NO: 556 - DNA, 69 bp, Artificial Sequence
  Synthetic oligonucleotide
acccaagaccctgcctcttccactccacccttctccagggacccttagatcacatcactccacccctgc

SEQ ID NO: 557 - DNA, 19 bp, Artificial Sequence
  Synthetic oligonucleotide
gagttcaagtgccctgacg

SEQ ID NO: 558 - DNA, 20 bp, Artificial Sequence
  Synthetic oligonucleotide
agttgtaatggcaggcacag

SEQ ID NO: 559 - DNA, 28 bp, Artificial Sequence
  Synthetic oligonucleotide
aacatcatgttcttcttcatgacctcgc

SEQ ID NO: 560 - DNA, 76 bp, Artificial Sequence
  Synthetic oligonucleotide
gagttcaagtgccctgacggcgaggtcatgaagaagaacatgatgttcatcaagacctgtgcctgccattacaact

SEQ ID NO: 561 - DNA, 20 bp, Artificial Sequence
  Synthetic oligonucleotide
tggctcacttcggctaaaat

SEQ ID NO: 562 - DNA, 21 bp, Artificial Sequence
  Synthetic oligonucleotide
tcagctccattgaatgtgaaa

SEQ ID NO: 563 - DNA, 24 bp, Artificial Sequence
  Synthetic oligonucleotide
caacgctgacagcatgcatttctg

SEQ ID NO: 564 - DNA, 69 bp, Artificial Sequence
  Synthetic oligonucleotide
tggctcacttcggctaaaatgcagaaatgcatgctgtcagcgttggtatttcacattcaatggagctga

SEQ ID NO: 565 - DNA, 23 bp, Artificial Sequence
  Synthetic oligonucleotide
cgttccgatcctctatactgcat

SEQ ID NO: 566 - DNA, 22 bp, Artificial Sequence
  Synthetic oligonucleotide
aggtccctgttggccttatagg

SEQ ID NO: 567 - DNA, 25 bp, Artificial Sequence
  Synthetic oligonucleotide
atgcctacagcaccctgatgtcgca

SEQ ID NO: 568 - DNA, 78 bp, Artificial Sequence
  Synthetic oligonucleotide
cgttccgatcctctatactgcatcccaggcatgcctacagcaccctgatgtcgcagcctataaggccaacagggacct

SEQ ID NO: 569 - DNA, 22 bp, Artificial Sequence
  Synthetic oligonucleotide
ggctcttgtgcgtactgtcctt

SEQ ID NO: 570 - DNA, 23 bp, Artificial Sequence
  Synthetic oligonucleotide
tcagatgacgaagagcacagatg

SEQ ID NO: 571 - DNA, 29 bp, Artificial Sequence
  Synthetic oligonucleotide
aggctcagtgatgtcttccctgtcaccag

SEQ ID NO: 572 - DNA, 80 bp, Artificial Sequence
  Synthetic oligonucleotide
ggctcttgtgcgtactgtccttcgggctggtgacagggaagacatcactgagcctgccatctgtgctcttcgtcatctga

SEQ ID NO: 573 - DNA, 20 bp, Artificial Sequence
  Synthetic oligonucleotide
cggaaacttcgggaatgtga

SEQ ID NO: 574 - DNA, 22 bp, Artificial Sequence
  Synthetic oligonucleotide
ctgaatccttctgcccaatctc

SEQ ID NO: 575 - DNA, 28 bp, Artificial Sequence
  Synthetic oligonucleotide
ttgatgccctcattttcattgttcaggc

SEQ ID NO: 576 - DNA, 79 bp, Artificial Sequence
  Synthetic oligonucleotide
cggaaacttcgggaatgtgatggtttagttgatgccctcattttcattgttcaggctgagattgggcagaaggattcag

SEQ ID NO: 577 - DNA, 19 bp, Artificial Sequence
  Synthetic oligonucleotide
gcccgtccctacagtgaac

SEQ ID NO: 578 - DNA, 18 bp, Artificial Sequence
  Synthetic oligonucleotide
ctcacacccaggagtcgg

SEQ ID NO: 579 - DNA, 24 bp, Artificial Sequence
  Synthetic oligonucleotide
ctatgaaacgagccactacccggc

SEQ ID NO: 580 - DNA, 70 bp, Artificial Sequence
  Synthetic oligonucleotide
gcccgtccctacagtgaactgaactatgaaacgagccactacccggcctcccccgactcctgggtgtgag

SEQ ID NO: 581 - DNA, 20 bp, Artificial Sequence
  Synthetic oligonucleotide
ggccgagatctacaaaaacg

SEQ ID NO: 582 - DNA, 20 bp, Artificial Sequence
  Synthetic oligonucleotide
gcaggaagtccgaatacaca

SEQ ID NO: 583 - DNA, 21 bp, Artificial Sequence
  Synthetic oligonucleotide
ccccgtggagggagctttctc

SEQ ID NO: 584 - DNA, 62 bp, Artificial Sequence
  Synthetic oligonucleotide
ggccgagatctacaaaaacggccccgtggagggagctttctctgtgtattcggacttcctgc

SEQ ID NO: 585 - DNA, 24 bp, Artificial Sequence
  Synthetic oligonucleotide
gtacatgatcccctgtgagaaggt

SEQ ID NO: 586 - DNA, 21 bp, Artificial Sequence
  Synthetic oligonucleotide
gggacagcttgtagcctttgc

SEQ ID NO: 587 - DNA, 22 bp, Artificial Sequence
  Synthetic oligonucleotide
accctgcccgcgatcacactga

SEQ ID NO: 588 - DNA, 80 bp, Artificial Sequence
  Synthetic oligonucleotide
gtacatgatcccctgtgagaaggtgtccaccctgcccgcgatcacactgaagctgggaggcaaaggctacaagctgtccc

SEQ ID NO: 589 - DNA, 22 bp, Artificial Sequence
  Synthetic oligonucleotide
aggcttctcttggtgtccatac

SEQ ID NO: 590 - DNA, 21 bp, Artificial Sequence
  Synthetic oligonucleotide
ccacctcttcactggtcatgt

SEQ ID NO: 591 - DNA, 24 bp, Artificial Sequence
  Synthetic oligonucleotide
ccccaggtggttcatagccagttc

SEQ ID NO: 592 - DNA, 72 bp, Artificial Sequence
  Synthetic oligonucleotide
aggcttctcttggtgtccatacatatgaactggctatgaaccacctgggggacatgaccagtgaagaggtgg

SEQ ID NO: 593 - DNA, 21 bp, Artificial Sequence
  Synthetic oligonucleotide
tgtctcactgagcgagcagaa

SEQ ID NO: 594 - DNA, 19 bp, Artificial Sequence
  Synthetic oligonucleotide
accattgcagccctgattg

SEQ ID NO: 595 - DNA, 24 bp, Artificial Sequence
  Synthetic oligonucleotide
cttgaggacgcgaacagtccacca

SEQ ID NO: 596 - DNA, 67 bp, Artificial Sequence
  Synthetic oligonucleotide
tgtctcactgagcgagcagaatctggtggactgttcgcgtcctcaaggcaatcagggctgcaatggt

SEQ ID NO: 597 - DNA, 22 bp, Artificial Sequence
  Synthetic oligonucleotide
tgacaacggctttccagtacat

SEQ ID NO: 598 - DNA, 22 bp, Artificial Sequence
  Synthetic oligonucleotide
tccatggctttgtagggatagg

SEQ ID NO: 599 - DNA, 28 bp, Artificial Sequence
  Synthetic oligonucleotide
tgataacaagggcatcgactcagacgct

SEQ ID NO: 600 - DNA, 76 bp, Artificial Sequence
  Synthetic oligonucleotide
tgacaacggctttccagtacatcattgataacaagggcatcgactcagacgcttcctatccctacaaagccatgga

SEQ ID NO: 601 - DNA, 21 bp, Artificial Sequence
  Synthetic oligonucleotide
atgccctggtaatgtctgcat

SEQ ID NO: 602 - DNA, 21 bp, Artificial Sequence
  Synthetic oligonucleotide
gcgaccacaagccttatcaag

SEQ ID NO: 603 - DNA, 24 bp, Artificial Sequence
  Synthetic oligonucleotide
cagccacaaagccagcgtcattgt

SEQ ID NO: 604 - DNA, 71 bp, Artificial Sequence
  Synthetic oligonucleotide
atgccctggtaatgtctgcattcaacaatgacgctggctttgtggctgctcttgataaggcttgtggtcgc

SEQ ID NO: 605 - DNA, 19 bp, Artificial Sequence
  Synthetic oligonucleotide
gagctacagatgcccatgc

SEQ ID NO: 606 - DNA, 20 bp, Artificial Sequence
  Synthetic oligonucleotide
tttgagatgcttgacgttgg

SEQ ID NO: 607 - DNA, 24 bp, Artificial Sequence
  Synthetic oligonucleotide
ttcttcgaaagccatgttgccaga

SEQ ID NO: 608 - DNA, 67 bp, Artificial Sequence
  Synthetic oligonucleotide
gagctacagatgcccatgccgattcttcgaaagccatgttgccagagccaacgtcaagcatctcaaa

SEQ ID NO: 609 - DNA, 20 bp, Artificial Sequence
  Synthetic oligonucleotide
tgaccgcttctaccccaatg

SEQ ID NO: 610 - DNA, 22 bp, Artificial Sequence
  Synthetic oligonucleotide
aggataaggccaaccatgatgt

SEQ ID NO: 611 - DNA, 28 bp, Artificial Sequence
  Synthetic oligonucleotide
ctgaaactggaacacaaccacccacaag

SEQ ID NO: 612 - DNA, 72 bp, Artificial Sequence
  Synthetic oligonucleotide
tgaccgcttctaccccaatgacttgtgggtggttgtgttccagtttcagcacatcatggttggccttatcct

SEQ ID NO: 613 - DNA, 18 bp, Artificial Sequence
  Synthetic oligonucleotide
cgcctcagaacgatggat

SEQ ID NO: 614 - DNA, 18 bp, Artificial Sequence
  Synthetic oligonucleotide
gttgcatggccagctgat

SEQ ID NO: 615 - DNA, 24 bp, Artificial Sequence
  Synthetic oligonucleotide
ctcagagccagggaacttctcgga

SEQ ID NO: 616 - DNA, 78 bp, Artificial Sequence
  Synthetic oligonucleotide
cgcctcagaacgatggatctgcatctcttcgactactcagagccagggaacttctcggacatcagctggccatgcaac

SEQ ID NO: 617 - DNA, 21 bp, Artificial Sequence
  Synthetic oligonucleotide
tcattgcccagtatggagatg

SEQ ID NO: 618 - DNA, 20 bp, Artificial Sequence
  Synthetic oligonucleotide
gacaggcttgcctttctctg

SEQ ID NO: 619 - DNA, 24 bp, Artificial Sequence
  Synthetic oligonucleotide
tcccgcctcaagtttctcaccaat

SEQ ID NO: 620 - DNA, 68 bp, Artificial Sequence
  Synthetic oligonucleotide
tcattgcccagtatggagatgtattggtgagaaacttgaggcgggaagcagagaaaggcaagcctgtc

SEQ ID NO: 621 - DNA, 20 bp, Artificial Sequence
  Synthetic oligonucleotide
tgctcattcttgaggagcat

SEQ ID NO: 622 - DNA, 20 bp, Artificial Sequence
  Synthetic oligonucleotide
gtggctgcattagtgtccat

SEQ ID NO: 623 - DNA, 24 bp, Artificial Sequence
  Synthetic oligonucleotide
cagcacccttggcagtttcgaaat

SEQ ID NO: 624 - DNA, 76 bp, Artificial Sequence
  Synthetic oligonucleotide
tgctcattcttgaggagcattaaggtatttcgaaactgccaagggtgctggtgcggatggacactaatgcagccac

SEQ ID NO: 625 - DNA, 18 bp, Artificial Sequence
  Synthetic oligonucleotide
gtgactgggctcatgcct

SEQ ID NO: 626 - DNA, 20 bp, Artificial Sequence
  Synthetic oligonucleotide
atcccacttgtgctcctgtc

SEQ ID NO: 627 - DNA, 24 bp, Artificial Sequence
  Synthetic oligonucleotide
caagtcagagtttccctggtgccc

SEQ ID NO: 628 - DNA, 67 bp, Artificial Sequence
  Synthetic oligonucleotide
gtgactgggctcatgcctccaagtcagagtttccctggtgccccagagacaggagcacaagtgggat

SEQ ID NO: 629 - DNA, 18 bp, Artificial Sequence
  Synthetic oligonucleotide
ccagcctttctggtgctg

SEQ ID NO: 630 - DNA, 18 bp, Artificial Sequence
  Synthetic oligonucleotide
gaccaggtctgcctctgc

SEQ ID NO: 631 - DNA, 24 bp, Artificial Sequence
  Synthetic oligonucleotide
ctcaccagctggcagacgtgaact

SEQ ID NO: 632 - DNA, 67 bp, Artificial Sequence
  Synthetic oligonucleotide
ccagcctttctggtgctgttctccagttcacgtctgccagctggtgagggcagaggcagacctggtc

SEQ ID NO: 633 - DNA, 22 bp, Artificial Sequence
  Synthetic oligonucleotide
cgctgacatcatgaatgttcct

SEQ ID NO: 634 - DNA, 24 bp, Artificial Sequence
  Synthetic oligonucleotide
tctctttcagcaacgatgtgtctt

SEQ ID NO: 635 - DNA, 25 bp, Artificial Sequence
  Synthetic oligonucleotide
tcatatccaaactcgcctccagccg

SEQ ID NO: 636 - DNA, 77 bp, Artificial Sequence
  Synthetic oligonucleotide
cgctgacatcatgaatgttcctcgaccggctggaggcgagtttggatatgacaaagacacatcgttgctgaaagaga

SEQ ID NO: 637 - DNA, 20 bp, Artificial Sequence
  Synthetic oligonucleotide
gccctcattagtccttggct

SEQ ID NO: 638 - DNA, 19 bp, Artificial Sequence
  Synthetic oligonucleotide
cagacagaagggctgggac

SEQ ID NO: 639 - DNA, 24 bp, Artificial Sequence
  Synthetic oligonucleotide
tcagcgcctgtgcttccaagataa

SEQ ID NO: 640 - DNA, 69 bp, Artificial Sequence
  Synthetic oligonucleotide
gccctcattagtccttggctcttatcttggaagcacaggcgctgacagccgtcccagcccttctgtctg

SEQ ID NO: 641 - DNA, 18 bp, Artificial Sequence
  Synthetic oligonucleotide
cctggcgtctgtcctcac

SEQ ID NO: 642 - DNA, 18 bp, Artificial Sequence
  Synthetic oligonucleotide
cgaagaggaggtggacga

SEQ ID NO: 643 - DNA, 24 bp, Artificial Sequence
  Synthetic oligonucleotide
ctagcctttgggaccgcttctcgt

SEQ ID NO: 644 - DNA, 67 bp, Artificial Sequence
  Synthetic oligonucleotide
cctggcgtctgtcctcaccatgcctagcctttgggaccgcttctcgtcgtcgtccacctcctcttcg

SEQ ID NO: 645 - DNA, 19 bp, Artificial Sequence
  Synthetic oligonucleotide
ctattaccggatccagggc

SEQ ID NO: 646 - DNA, 20 bp, Artificial Sequence
  Synthetic oligonucleotide
cccagcaagatactctccca

SEQ ID NO: 647 - DNA, 24 bp, Artificial Sequence
  Synthetic oligonucleotide
agtgctccctatccgctggatgtc

SEQ ID NO: 648 - DNA, 69 bp, Artificial Sequence
  Synthetic oligonucleotide
ctattaccggatccagggccgggcagtgctccctatccgctggatgtcttgggagagtatcttgctggg

SEQ ID NO: 649 - DNA, 18 bp, Artificial Sequence
  Synthetic oligonucleotide
acttctcactggccgacg

SEQ ID NO: 650 - DNA, 19 bp, Artificial Sequence
  Synthetic oligonucleotide
gctccaccttctcgttggt

SEQ ID NO: 651 - DNA, 24 bp, Artificial Sequence
  Synthetic oligonucleotide
tgaaccaggagtttctgaccacgc

SEQ ID NO: 652 - DNA, 66 bp, Artificial Sequence
  Synthetic oligonucleotide
acttctcactggccgacgcggtgaaccaggagtttctgaccacgcgcaccaacgagaaggtggagc

SEQ ID NO: 653 - DNA, 20 bp, Artificial Sequence
  Synthetic oligonucleotide
ggagaaaggtctctggggtc

SEQ ID NO: 654 - DNA, 18 bp, Artificial Sequence
  Synthetic oligonucleotide
cagtcagtgggagccagc

SEQ ID NO: 655 - DNA, 24 bp, Artificial Sequence
  Synthetic oligonucleotide
atcaataatgctggtgttcccggc

SEQ ID NO: 656 - DNA, 66 bp, Artificial Sequence
  Synthetic oligonucleotide
ggagaaaggtctctggggtctgatcaataatgctggtgttcccggcgtgctggctcccactgactg

SEQ ID NO: 657 - DNA, 20 bp, Artificial Sequence
  Synthetic oligonucleotide
gttcgaaccatctcagcgac

SEQ ID NO: 658 - DNA, 20 bp, Artificial Sequence
  Synthetic oligonucleotide
tccagttggattgtggaggt

SEQ ID NO: 659 - DNA, 24 bp, Artificial Sequence
  Synthetic oligonucleotide
ccaaggaaccacacccacttggtt

SEQ ID NO: 660 - DNA, 68 bp, Artificial Sequence
  Synthetic oligonucleotide
gttcgaaccatctcagcgacaaaaccaagtgggtgtggttccttggtcacctccacaatccaactgga

SEQ ID NO: 661 - DNA, 20 bp, Artificial Sequence
  Synthetic oligonucleotide
caagcagtcaaggagaacca

SEQ ID NO: 662 - DNA, 20 bp, Artificial Sequence
  Synthetic oligonucleotide
agttttgctcgcctcatctt

SEQ ID NO: 663 - DNA, 22 bp, Artificial Sequence
  Synthetic oligonucleotide
ttcttctgtctcccgccgcttc

SEQ ID NO: 664 - DNA, 62 bp, Artificial Sequence
  Synthetic oligonucleotide
caagcagtcaaggagaaccagaagcggcgggagacagaagaaaagatgaggcgagcaaaact

SEQ ID NO: 665 - DNA, 20 bp, Artificial Sequence
  Synthetic oligonucleotide
tccaattccagcatcactgt

SEQ ID NO: 666 - DNA, 20 bp, Artificial Sequence
  Synthetic oligonucleotide
ggcagtgaaggcgataaagt

SEQ ID NO: 667 - DNA, 25 bp, Artificial Sequence
  Synthetic oligonucleotide
agaaaagctgtttgtctccccagca

SEQ ID NO: 668 - DNA, 68 bp, Artificial Sequence
  Synthetic oligonucleotide
tccaattccagcatcactgtggagaaaagctgtttgtctccccagcatactttatcgccttcactgcc

SEQ ID NO: 669 - DNA, 18 bp, Artificial Sequence
  Synthetic oligonucleotide
ctcctttcacgagccagc

SEQ ID NO: 670 - DNA, 20 bp, Artificial Sequence
  Synthetic oligonucleotide
aggaagtcagccactgagga

SEQ ID NO: 671 - DNA, 24 bp, Artificial Sequence
  Synthetic oligonucleotide
actcttccaccagtttgcggaagg

SEQ ID NO: 672 - DNA, 70 bp, Artificial Sequence
  Synthetic oligonucleotide
ctcctttcacgagccagctgccagccttccgcaaactggtggaagagttctcctcagtggctgacttcct

SEQ ID NO: 673 - DNA, 20 bp, Artificial Sequence
  Synthetic oligonucleotide
gattcagacgaggatgagcc

SEQ ID NO: 674 - DNA, 20 bp, Artificial Sequence
  Synthetic oligonucleotide
cacctcttgctgtccctttg

SEQ ID NO: 675 - DNA, 24 bp, Artificial Sequence
  Synthetic oligonucleotide
aaagtccatttgccactgatggca

SEQ ID NO: 676 - DNA, 68 bp, Artificial Sequence
  Synthetic oligonucleotide
gattcagacgaggatgagccttgtgccatcagtggcaaatggactttccaaagggacagcaagaggtg

SEQ ID NO: 677 - DNA, 18 bp, Artificial Sequence
  Synthetic oligonucleotide
ctgctgagcccagtggag

SEQ ID NO: 678 - DNA, 18 bp, Artificial Sequence
  Synthetic oligonucleotide
agcctggaaggagttccg

SEQ ID NO: 679 - DNA, 24 bp, Artificial Sequence
  Synthetic oligonucleotide
cgcagaccacccatactacaccca

SEQ ID NO: 680 - DNA, 69 bp, Artificial Sequence
  Synthetic oligonucleotide
ctgctgagcccagtggagcaccaccccgcagaccacccatactacacccagcggaactccttccaggct

SEQ ID NO: 681 - DNA, 21 bp, Artificial Sequence
  Synthetic oligonucleotide
cacggaggtataaggcaggag

SEQ ID NO: 682 - DNA, 18 bp, Artificial Sequence
  Synthetic oligonucleotide
agaaggaaggtccagccg

SEQ ID NO: 683 - DNA, 24 bp, Artificial Sequence
  Synthetic oligonucleotide
ctacctggacatccctgctcagcc

SEQ ID NO: 684 - DNA, 67 bp, Artificial Sequence
  Synthetic oligonucleotide
cacggaggtataaggcaggagcctacctggacatccctgctcagccccgcggctggaccttccttct

SEQ ID NO: 685 - DNA, 18 bp, Artificial Sequence
  Synthetic oligonucleotide
ctttcccacccggcttac

SEQ ID NO: 686 - DNA, 20 bp, Artificial Sequence
  Synthetic oligonucleotide
aaggaccttctgcaggtgtg

SEQ ID NO: 687 - DNA, 24 bp, Artificial Sequence
  Synthetic oligonucleotide
catatcgctgaccgaatgggaacc

SEQ ID NO: 688 - DNA, 66 bp, Artificial Sequence
  Synthetic oligonucleotide
ctttcccacccggcttacagacatatcgctgaccgaatgggaaccccacacctgcagaaggtcctt

SEQ ID NO: 689 - DNA, 18 bp, Artificial Sequence
  Synthetic oligonucleotide
gtcctgggatcgggaagt

SEQ ID NO: 690 - DNA, 20 bp, Artificial Sequence
  Synthetic oligonucleotide
gtactcccaccgggatacag

SEQ ID NO: 691 - DNA, 24 bp, Artificial Sequence
  Synthetic oligonucleotide
cggctattccacacttgaacacgc

SEQ ID NO: 692 - DNA, 69 bp, Artificial Sequence
  Synthetic oligonucleotide
gtcctgggatcgggaagtggcgtgttcaagtgtggaatagccgtggcgcctgtatcccggtgggagtac

SEQ ID NO: 693 - DNA, 19 bp, Artificial Sequence
  Synthetic oligonucleotide
cacctagaagcctgcccac

SEQ ID NO: 694 - DNA, 19 bp, Artificial Sequence
  Synthetic oligonucleotide
cagtagctccccagggttc

SEQ ID NO: 695 - DNA, 24 bp, Artificial Sequence
  Synthetic oligonucleotide
ttcctaggaaggctggcagacacc

SEQ ID NO: 696 - DNA, 67 bp, Artificial Sequence
  Synthetic oligonucleotide
cacctagaagcctgcccacgattcctaggaaggctggcagacaccctggaaccctggggagctactg

SEQ ID NO: 697 - DNA, 20 bp, Artificial Sequence
  Synthetic oligonucleotide
agacatcagctcctggttca

SEQ ID NO: 698 - DNA, 20 bp, Artificial Sequence
  Synthetic oligonucleotide
gacaaacacccttcctccag

SEQ ID NO: 699 - DNA, 26 bp, Artificial Sequence
  Synthetic oligonucleotide
cgaggccattgacttcatagactcca

SEQ ID NO: 700 - DNA, 76 bp, Artificial Sequence
  Synthetic oligonucleotide
agacatcagctcctggttcaacgaggccattgacttcatagactccatcaagaatgctggaggaagggtgtttgtc

SEQ ID NO: 701 - DNA, 18 bp, Artificial Sequence
  Synthetic oligonucleotide
catgcagggactgggatt

SEQ ID NO: 702 - DNA, 21 bp, Artificial Sequence
  Synthetic oligonucleotide
tgctcctaccctatcatttgg

SEQ ID NO: 703 - DNA, 24 bp, Artificial Sequence
  Synthetic oligonucleotide
tctaccctatgcgcctggaagtcc

SEQ ID NO: 704 - DNA, 67 bp, Artificial Sequence
  Synthetic oligonucleotide
catgcagggactgggattcgaggacttccaggcgcatagggtagaaccaaatgatagggtaggagca

SEQ ID NO: 705 - DNA, 18 bp, Artificial Sequence
  Synthetic oligonucleotide
tctgtcccacctgctgct

SEQ ID NO: 706 - DNA, 18 bp, Artificial Sequence
  Synthetic oligonucleotide
tcagactgttgccggatg

SEQ ID NO: 707 - DNA, 24 bp, Artificial Sequence
  Synthetic oligonucleotide
cttggagcagcctgcaccttctct

SEQ ID NO: 708 - DNA, 69 bp, Artificial Sequence
  Synthetic oligonucleotide
tctgtcccacctgctgctgccccttggagcagcctgcaccttctctcctcccatccggcaacagtctga

SEQ ID NO: 709 - DNA, 18 bp, Artificial Sequence
  Synthetic oligonucleotide
gccgcctacctcacagac

SEQ ID NO: 710 - DNA, 19 bp, Artificial Sequence
  Synthetic oligonucleotide
gcctgactccagctctcct

SEQ ID NO: 711 - DNA, 24 bp, Artificial Sequence
  Synthetic oligonucleotide
acccacgtcagtgagtgctcacaa

SEQ ID NO: 712 - DNA, 84 bp, Artificial Sequence
  Synthetic oligonucleotide
gccgcctacctcacagacttgtgagcactcactgacgtgggtagcgcccagggcctgcggggcgcaggagagctggagtcaggc

SEQ ID NO: 713 - DNA, 18 bp, Artificial Sequence
  Synthetic oligonucleotide
tgcggcgagatggacact

SEQ ID NO: 714 - DNA, 22 bp, Artificial Sequence
  Synthetic oligonucleotide
gtgacaagggattcatcggatt

SEQ ID NO: 715 - DNA, 22 bp, Artificial Sequence
  Synthetic oligonucleotide
cccgctctcggattcggagtcg

SEQ ID NO: 716 - DNA, 65 bp, Artificial Sequence
  Synthetic oligonucleotide
tgcggcgagatggacactcccccgctctcggattcggagtcggaatccgatgaatcccttgtcac

SEQ ID NO: 717 - DNA, 18 bp, Artificial Sequence
  Synthetic oligonucleotide
accttgggatctgcctcc

SEQ ID NO: 718 - DNA, 19 bp, Artificial Sequence
  Synthetic oligonucleotide
ggaccaggacctccatctg

SEQ ID NO: 719 - DNA, 24 bp, Artificial Sequence
  Synthetic oligonucleotide
tccactctcgataccctgcaccag

SEQ ID NO: 720 - DNA, 67 bp, Artificial Sequence
  Synthetic oligonucleotide
accttgggatctgcctccaagctggtgcagggtatcgagagtggattccagatggaggtcctggtcc

SEQ ID NO: 721 - DNA, 20 bp, Artificial Sequence
  Synthetic oligonucleotide
tgccacctggacatcatttg

SEQ ID NO: 722 - DNA, 21 bp, Artificial Sequence
  Synthetic oligonucleotide
tggacctagggcttccaagtc

SEQ ID NO: 723 - DNA, 23 bp, Artificial Sequence
  Synthetic oligonucleotide
cactcccgagcacgttgttccgt

SEQ ID NO: 724 - DNA, 73 bp, Artificial Sequence
  Synthetic oligonucleotide
tgccacctggacatcatttgggtcaacactcccgagcacgttgttccgtatggacttggaagccctaggtcca

SEQ ID NO: 725 - DNA, 21 bp, Artificial Sequence
  Synthetic oligonucleotide
tttcctcaaatttgcctcaag

SEQ ID NO: 726 - DNA, 20 bp, Artificial Sequence
  Synthetic oligonucleotide
ttacacatccaaccagtgcc

SEQ ID NO: 727 - DNA, 23 bp, Artificial Sequence
  Synthetic oligonucleotide
cctttgcctcagggcatcctttt

SEQ ID NO: 728 - DNA, 76 bp, Artificial Sequence
  Synthetic oligonucleotide
tttcctcaaatttgcctcaagatggaaaccctttgcctcagggcatccttttggctggcactggttggatgtgtaa

SEQ ID NO: 729 - DNA, 23 bp, Artificial Sequence
  Synthetic oligonucleotide
tgacattatcatcccgctaagga

SEQ ID NO: 730 - DNA, 21 bp, Artificial Sequence
  Synthetic oligonucleotide
gtagtccccgctgaccttctc

SEQ ID NO: 731 - DNA, 24 bp, Artificial Sequence
  Synthetic oligonucleotide
cggacagcgtcttctgccctcact

SEQ ID NO: 732 - DNA, 73 bp, Artificial Sequence
  Synthetic oligonucleotide
tgacattatcatcccgctaaggactgcggacagcgtcttctgccctcactacgagaaggtcagcggggactac

SEQ ID NO: 733 - DNA, 22 bp, Artificial Sequence
  Synthetic oligonucleotide
ctttgccttgctctgtcacagt

SEQ ID NO: 734 - DNA, 27 bp, Artificial Sequence
  Synthetic oligonucleotide
aaatacctgacacccttatgacaaatt

SEQ ID NO: 735 - DNA, 30 bp, Artificial Sequence
  Synthetic oligonucleotide
agagtttaacagccctgctctggctgactt

SEQ ID NO: 736 - DNA, 84 bp, Artificial Sequence
  Synthetic oligonucleotide
ctttgccttgctctgtcacagtgaagtcagccagagcagggctgttaaactctgtgaaatttgtcataagggtgtcaggtattt

SEQ ID NO: 737 - DNA, 19 bp, Artificial Sequence
  Synthetic oligonucleotide
gtccccgctgcagatctct

SEQ ID NO: 738 - DNA, 24 bp, Artificial Sequence
  Synthetic oligonucleotide
ctccagcttagggtagttgtccat

SEQ ID NO: 739 - DNA, 23 bp, Artificial Sequence
  Synthetic oligonucleotide
cggatcctttcctcactcgccca

SEQ ID NO: 740 - DNA, 76 bp, Artificial Sequence
  Synthetic oligonucleotide
gtccccgctgcagatctctgacccgttcggatcctttcctcactcgcccaccatggacaactaccctaagctggag

SEQ ID NO: 741 - DNA, 20 bp, Artificial Sequence
  Synthetic oligonucleotide
ccatgtggatgaatgaggtg

SEQ ID NO: 742 - DNA, 20 bp, Artificial Sequence
  Synthetic oligonucleotide
tgcctgagaagaggtgaggt

SEQ ID NO: 743 - DNA, 24 bp, Artificial Sequence
  Synthetic oligonucleotide
acccagtctcaccttctccccacc

SEQ ID NO: 744 - DNA, 78 bp, Artificial Sequence
  Synthetic oligonucleotide
ccatgtggatgaatgaggtgtctcctttccatacccagtctcaccttctccccaccctacctcacctcttctcaggca

SEQ ID NO: 745 - DNA, 18 bp, Artificial Sequence
  Synthetic oligonucleotide
gcactgtgggcagatgaa

SEQ ID NO: 746 - DNA, 18 bp, Artificial Sequence
  Synthetic oligonucleotide
atgtttggtgactggcgg

SEQ ID NO: 747 - DNA, 24 bp, Artificial Sequence
  Synthetic oligonucleotide
cgggtcacattgcagacacggtac

SEQ ID NO: 748 - DNA, 71 bp, Artificial Sequence
  Synthetic oligonucleotide
gcactgtgggcagatgaagaggaagtaccgcgtctgcaatgtgacccggcggcccgccagtcaccaaacat

SEQ ID NO: 749 - DNA, 20 bp, Artificial Sequence
  Synthetic oligonucleotide
ctgcctccctgattcaagtg

SEQ ID NO: 750 - DNA, 22 bp, Artificial Sequence
  Synthetic oligonucleotide
ggtggcaagtgcctgtaatatc

SEQ ID NO: 751 - DNA, 24 bp, Artificial Sequence
  Synthetic oligonucleotide
tctcgtgcttcagcctcccatgta

SEQ ID NO: 752 - DNA, 71 bp, Artificial Sequence
  Synthetic oligonucleotide
ctgcctccctgattcaagtgattctcgtgcttcagcctcccatgtagctgatattacaggcacttgccacc

SEQ ID NO: 753 - DNA, 20 bp, Artificial Sequence
  Synthetic oligonucleotide
ctcattgcaggccagataaa

SEQ ID NO: 754 - DNA, 19 bp, Artificial Sequence
  Synthetic oligonucleotide
gccatgaagagcttgccta

SEQ ID NO: 755 - DNA, 26 bp, Artificial Sequence
  Synthetic oligonucleotide
cagaacatcaaggagttcactgccca

SEQ ID NO: 756 - DNA, 80 bp, Artificial Sequence
  Synthetic oligonucleotide
ctcattgcaggccagataaacacttactgccagaacatcaaggagttcactgcccaaaacttaggcaagctcttcatggc

SEQ ID NO: 757 - DNA, 23 bp, Artificial Sequence
  Synthetic oligonucleotide
gatctaagatggcgactgtcgaa

SEQ ID NO: 758 - DNA, 25 bp, Artificial Sequence
  Synthetic oligonucleotide
ttagattccgttttctcctcttctg

SEQ ID NO: 759 - DNA, 27 bp, Artificial Sequence
  Synthetic oligonucleotide
accacccctactcctaatcccccgact

SEQ ID NO: 760 - DNA, 82 bp, Artificial Sequence
  Synthetic oligonucleotide
gatctaagatggcgactgtcgaaccggaaaccacccctactcctaatcccccgactacagaagaggagaaaacggaatctaa

SEQ ID NO: 761 - DNA, 19 bp, Artificial Sequence
  Synthetic oligonucleotide
gaattggtctccagctgcc

SEQ ID NO: 762 - DNA, 20 bp, Artificial Sequence
  Synthetic oligonucleotide
tccaggtatatggctcctgc

SEQ ID NO: 763 - DNA, 24 bp, Artificial Sequence
  Synthetic oligonucleotide
ccacttgcacccgaatcttgatca

SEQ ID NO: 764 - DNA, 66 bp, Artificial Sequence
  Synthetic oligonucleotide
gaattggtctccagctgcctttgatcaagattcgggtgcaagtggagcaggagccatatacctgga

SEQ ID NO: 765 - DNA, 20 bp, Artificial Sequence
  Synthetic oligonucleotide
gatgtggagaatggagggaa

SEQ ID NO: 766 - DNA, 20 bp, Artificial Sequence
  Synthetic oligonucleotide
agtcattgcggctagaggtc

SEQ ID NO: 767 - DNA, 24 bp, Artificial Sequence
  Synthetic oligonucleotide
ataaaccacctcagcctggtgcca

SEQ ID NO: 768 - DNA, 67 bp, Artificial Sequence
  Synthetic oligonucleotide
gatgtggagaatggagggaaagataaaccacctcagcctggtgccaagacctctagccgcaatgact

SEQ ID NO: 769 - DNA, 21 bp, Artificial Sequence
  Synthetic oligonucleotide
ctcctgcgcactaataccttc

SEQ ID NO: 770 - DNA, 20 bp, Artificial Sequence
  Synthetic oligonucleotide
tccctggataattgggtctg

SEQ ID NO: 771 - DNA, 24 bp, Artificial Sequence
  Synthetic oligonucleotide
taacttcctctggcatggttggcc

SEQ ID NO: 772 - DNA, 67 bp, Artificial Sequence
  Synthetic oligonucleotide
ctcctgcgcactaataccttcaggccaaccatgccagaggaagttaccagacccaattatccaggga

SEQ ID NO: 773 - DNA, 21 bp, Artificial Sequence
  Synthetic oligonucleotide
cctcaaagagttgctgagagc

SEQ ID NO: 774 - DNA, 21 bp, Artificial Sequence
  Synthetic oligonucleotide
cctctttacagtgtgccttca

SEQ ID NO: 775 - DNA, 30 bp, Artificial Sequence
  Synthetic oligonucleotide
ctgatccttccagccacattcaattaattt

SEQ ID NO: 776 - DNA, 74 bp, Artificial Sequence
  Synthetic oligonucleotide
cctcaaagagttgctgagagctaaattaattgaatgtggctggaaggatcagttgaaggcacactgtaaagagg

SEQ ID NO: 777 - DNA, 21 bp, Artificial Sequence
  Synthetic oligonucleotide
cgcctgttcaccaagattgac

SEQ ID NO: 778 - DNA, 18 bp, Artificial Sequence
  Synthetic oligonucleotide
gtggcgtgcctcgaagtc

SEQ ID NO: 779 - DNA, 20 bp, Artificial Sequence
  Synthetic oligonucleotide
tgcgcccgatgagatcaccg

SEQ ID NO: 780 - DNA, 72 bp, Artificial Sequence
  Synthetic oligonucleotide
cgcctgttcaccaagattgacaccattgcgcccgatgagatcaccgtcagcagcgacttcgaggcacgccac

SEQ ID NO: 781 - DNA, 20 bp, Artificial Sequence
  Synthetic oligonucleotide
cagtagcctcaagcctgaca

SEQ ID NO: 782 - DNA, 18 bp, Artificial Sequence
  Synthetic oligonucleotide
ttcgtcccatatccagcg

SEQ ID NO: 783 - DNA, 24 bp, Artificial Sequence
  Synthetic oligonucleotide
tattccaaatccgagcccgaacag

SEQ ID NO: 784 - DNA, 72 bp, Artificial Sequence
  Synthetic oligonucleotide
cagtagcctcaagcctgacactatatacgtattccaaatccgagcccgaacagccgctggatatgggacgaa

SEQ ID NO: 785 - DNA, 18 bp, Artificial Sequence
  Synthetic oligonucleotide
caaccaggcagctccatc

SEQ ID NO: 786 - DNA, 19 bp, Artificial Sequence
  Synthetic oligonucleotide
gtaatgctgtccacggtgc

SEQ ID NO: 787 - DNA, 24 bp, Artificial Sequence
  Synthetic oligonucleotide
cacctgatgcatgatggacactgc

SEQ ID NO: 788 - DNA, 66 bp, Artificial Sequence
  Synthetic oligonucleotide
caaccaggcagctccatcggcagtgtccatcatgcatcaggtgagccgcaccgtggacagcattac

SEQ ID NO: 789 - DNA, 20 bp, Artificial Sequence
  Synthetic oligonucleotide
tgaacggggtatcctcctta

SEQ ID NO: 790 - DNA, 20 bp, Artificial Sequence
  Synthetic oligonucleotide
aggtacctctcggtcagtgg

SEQ ID NO: 791 - DNA, 24 bp, Artificial Sequence
  Synthetic oligonucleotide
cgtcccatttgagcctgtcaatgt

SEQ ID NO: 792 - DNA, 77 bp, Artificial Sequence
  Synthetic oligonucleotide
tgaacggggtatcctccttagccacggggcccgtcccatttgagcctgtcaatgtcaccactgaccgagaggtacct

SEQ ID NO: 793 - DNA, 20 bp, Artificial Sequence
  Synthetic oligonucleotide
cggtgtgagaagtgcagcaa

SEQ ID NO: 794 - DNA, 19 bp, Artificial Sequence
  Synthetic oligonucleotide
cctctcgcaagtgctccat

SEQ ID NO: 795 - DNA, 24 bp, Artificial Sequence
  Synthetic oligonucleotide
ccagaccatagcacactcgggcac

SEQ ID NO: 796 - DNA, 70 bp, Artificial Sequence
  Synthetic oligonucleotide
cggtgtgagaagtgcagcaagccctgtgcccgagtgtgctatggtctgggcatggagcacttgcgagagg

SEQ ID NO: 797 - DNA, 23 bp, Artificial Sequence
  Synthetic oligonucleotide
cggttatgtcatgccagatacac

SEQ ID NO: 798 - DNA, 24 bp, Artificial Sequence
  Synthetic oligonucleotide
gaactgagacccactgaagaaagg

SEQ ID NO: 799 - DNA, 25 bp, Artificial Sequence
  Synthetic oligonucleotide
cctcaaaggtactccctcctcccgg

SEQ ID NO: 800 - DNA, 81 bp, Artificial Sequence
  Synthetic oligonucleotide
cggttatgtcatgccagatacacacctcaaaggtactccctcctcccgggaaggcaccctttcttcagtgggtctcagttc

SEQ ID NO: 801 - DNA, 25 bp, Artificial Sequence
  Synthetic oligonucleotide
tggctcttaatcagtttcgttacct

SEQ ID NO: 802 - DNA, 25 bp, Artificial Sequence
  Synthetic oligonucleotide
caaggcatatcgatcctcataaagt

SEQ ID NO: 803 - DNA, 30 bp, Artificial Sequence
  Synthetic oligonucleotide
tgtcccacgaataatgcgtaaattctccag

SEQ ID NO: 804 - DNA, 86 bp, Artificial Sequence
  Synthetic oligonucleotide
tggctcttaatcagtttcgttacctgcctctggagaatttacgcattattcgtgggacaaaactttatgaggatcgatatgccttg

SEQ ID NO: 805 - DNA, 20 bp, Artificial Sequence
  Synthetic oligonucleotide
gtccaggtggatgtgaaaga

SEQ ID NO: 806 - DNA, 20 bp, Artificial Sequence
  Synthetic oligonucleotide
cggccaggatacacatctta

SEQ ID NO: 807 - DNA, 21 bp, Artificial Sequence
  Synthetic oligonucleotide
cagcaggccctcaaggagctg

SEQ ID NO: 808 - DNA, 67 bp, Artificial Sequence
  Synthetic oligonucleotide
gtccaggtggatgtgaaagatccccagcaggccctcaaggagctggctaagatgtgtatcctggccg

SEQ ID NO: 809 - DNA, 20 bp, Artificial Sequence
  Synthetic oligonucleotide
tgctagggtaaacgaaggca

SEQ ID NO: 810 - DNA, 19 bp, Artificial Sequence
  Synthetic oligonucleotide
tggagacaagtcctggcac

SEQ ID NO: 811 - DNA, 24 bp, Artificial Sequence
  Synthetic oligonucleotide
taagccatggctgacctctggagc

SEQ ID NO: 812 - DNA, 71 bp, Artificial Sequence
  Synthetic oligonucleotide
tgctagggtaaacgaaggcataataagccatggctgacctctggagcaccaggtgccaggacttgtctcca

SEQ ID NO: 813 - DNA, 18 bp, Artificial Sequence
  Synthetic oligonucleotide
ccaacactaggctcccca

SEQ ID NO: 814 - DNA, 19 bp, Artificial Sequence
  Synthetic oligonucleotide
cctccgccaggtctttagt

SEQ ID NO: 815 - DNA, 24 bp, Artificial Sequence
  Synthetic oligonucleotide
agccatatgccttctcatctgggc

SEQ ID NO: 816 - DNA, 70 bp, Artificial Sequence
  Synthetic oligonucleotide
ccaacactaggctccccaccagccatatgccttctcatctgggcacttactactaaagacctggcggagg

SEQ ID NO: 817 - DNA, 19 bp, Artificial Sequence
  Synthetic oligonucleotide
cgtggtgcccctctatgac

SEQ ID NO: 818 - DNA, 19 bp, Artificial Sequence
  Synthetic oligonucleotide
ggctagtgggcgcatgtag

SEQ ID NO: 819 - DNA, 19 bp, Artificial Sequence
  Synthetic oligonucleotide
ctggagatgctggacgccc

SEQ ID NO: 820 - DNA, 68 bp, Artificial Sequence
  Synthetic oligonucleotide
cgtggtgcccctctatgacctgctgctggagatgctggacgcccaccgcctacatgcgcccactagcc

SEQ ID NO: 821 - DNA, 20 bp, Artificial Sequence
  Synthetic oligonucleotide
tggtccatcgccagttatca

SEQ ID NO: 822 - DNA, 23 bp, Artificial Sequence
  Synthetic oligonucleotide
tgttctagcgatcttgcttcaca

SEQ ID NO: 823 - DNA, 30 bp, Artificial Sequence
  Synthetic oligonucleotide
atctgtatgcggaacctcaaaagagtccct

SEQ ID NO: 824 - DNA, 76 bp, Artificial Sequence
  Synthetic oligonucleotide
tggtccatcgccagttatcacatctgtatgcggaacctcaaaagagtccctggtgtgaagcaagatcgctagaaca

SEQ ID NO: 825 - DNA, 20 bp, Artificial Sequence
  Synthetic oligonucleotide
tcaaacaagagccaggaatg

SEQ ID NO: 826 - DNA, 20 bp, Artificial Sequence
  Synthetic oligonucleotide
aactgccagagctgaagtga

SEQ ID NO: 827 - DNA, 24 bp, Artificial Sequence
  Synthetic oligonucleotide
atcgggaaggacccacataccaac

SEQ ID NO: 828 - DNA, 73 bp, Artificial Sequence
  Synthetic oligonucleotide
tcaaacaagagccaggaatgtatcgggaaggacccacataccaacggcgaggatcacttcagctctggcagtt

SEQ ID NO: 829 - DNA, 18 bp, Artificial Sequence
  Synthetic oligonucleotide
tccagtgcctatgacccc

SEQ ID NO: 830 - DNA, 18 bp, Artificial Sequence
  Synthetic oligonucleotide
actgtccaagggcaccag

SEQ ID NO: 831 - DNA, 24 bp, Artificial Sequence
  Synthetic oligonucleotide
cagacaaatcgccatcaagtcccc

SEQ ID NO: 832 - DNA, 67 bp, Artificial Sequence
  Synthetic oligonucleotide
tccagtgcctatgacccccccagacaaatcgccatcaagtcccctgcccctggtgcccttggacagt

SEQ ID NO: 833 - DNA, 20 bp, Artificial Sequence
  Synthetic oligonucleotide
tggaaacagcgaaggataca

SEQ ID NO: 834 - DNA, 20 bp, Artificial Sequence
  Synthetic oligonucleotide
caccgaacactccctagtcc

SEQ ID NO: 835 - DNA, 25 bp, Artificial Sequence
  Synthetic oligonucleotide
tcctgacttctgtgagctcattgcg

SEQ ID NO: 836 - DNA, 78 bp, Artificial Sequence
  Synthetic oligonucleotide
tggaaacagcgaaggatacagcctgtgcacatcctgacttctgtgagctcattgcgcgggactagggagtgttcggtg

SEQ ID NO: 837 - DNA, 19 bp, Artificial Sequence
  Synthetic oligonucleotide
aaggagcaaaccatccagg

SEQ ID NO: 838 - DNA, 19 bp, Artificial Sequence
  Synthetic oligonucleotide
gcagggtttcattgagcac

SEQ ID NO: 839 - DNA, 24 bp, Artificial Sequence
  Synthetic oligonucleotide
cccgggctcaacatcactacctgt

SEQ ID NO: 840 - DNA, 70 bp, Artificial Sequence
  Synthetic oligonucleotide
aaggagcaaaccatccaggtgcccgggctcaacatcactacctgtcatgatgtgctcaatgaaaccctgc

SEQ ID NO: 841 - DNA, 20 bp, Artificial Sequence
  Synthetic oligonucleotide
gacagcgtagtggtgcatgt

SEQ ID NO: 842 - DNA, 20 bp, Artificial Sequence
  Synthetic oligonucleotide
agctgaacatggactgtgga

SEQ ID NO: 843 - DNA, 21 bp, Artificial Sequence
  Synthetic oligonucleotide
tgcccttcgtgcacaccaatg

SEQ ID NO: 844 - DNA, 82 bp, Artificial Sequence
  Synthetic oligonucleotide
gacagcgtagtggtgcatgtgctgaagctgcagggtgccgtgcccttcgtgcacaccaatgttccacagtccatgttcagct

SEQ ID NO: 845 - DNA, 20 bp, Artificial Sequence
  Synthetic oligonucleotide
gctgatggcagaaaaactca

SEQ ID NO: 846 - DNA, 19 bp, Artificial Sequence
  Synthetic oligonucleotide
ctttccttcccatcccact

SEQ ID NO: 847 - DNA, 24 bp, Artificial Sequence
  Synthetic oligonucleotide
cctgatgctgaaccaatgcaccat

SEQ ID NO: 848 - DNA, 83 bp, Artificial Sequence
  Synthetic oligonucleotide
gctgatggcagaaaaactcagactgtctgcaactttacagatggtgcattggttcagcatcaggagtgggatgggaaggaaag

SEQ ID NO: 849 - DNA, 20 bp, Artificial Sequence
  Synthetic oligonucleotide
gttttcgcgagataacggtc

SEQ ID NO: 850 - DNA, 18 bp, Artificial Sequence
  Synthetic oligonucleotide
ctccggtgcctgattcac

SEQ ID NO: 851 - DNA, 24 bp, Artificial Sequence
  Synthetic oligonucleotide
aacgcgctcttgtcgatttcctgt

SEQ ID NO: 852 - DNA, 66 bp, Artificial Sequence
  Synthetic oligonucleotide
gttttcgcgagataacggtcgaaaacgcgctcttgtcgatttcctgtagtgaatcaggcaccggag

SEQ ID NO: 853 - DNA, 19 bp, Artificial Sequence
  Synthetic oligonucleotide
aagtcagggaaaacctgcg

SEQ ID NO: 854 - DNA, 19 bp, Artificial Sequence
  Synthetic oligonucleotide
gctggccctacagctctct

SEQ ID NO: 855 - DNA, 24 bp, Artificial Sequence
  Synthetic oligonucleotide
aattgccacactgaccagcgaaga

SEQ ID NO: 856 - DNA, 66 bp, Artificial Sequence
  Synthetic oligonucleotide
aagtcagggaaaacctgcggagaattgccacactgaccagcgaagagagagagctgtagggccagc

SEQ ID NO: 857 - DNA, 19 bp, Artificial Sequence
  Synthetic oligonucleotide
atcttcaaagcggagagcg

SEQ ID NO: 858 - DNA, 20 bp, Artificial Sequence
  Synthetic oligonucleotide
gctggataccacatgctctg

SEQ ID NO: 859 - DNA, 24 bp, Artificial Sequence
  Synthetic oligonucleotide
tcctgactttctccgtggctcctc

SEQ ID NO: 860 - DNA, 66 bp, Artificial Sequence
  Synthetic oligonucleotide
atcttcaaagcggagagcgggaggagccacggagaaagtcaggagacagagcatgtggtatccagc

SEQ ID NO: 861 - DNA, 20 bp, Artificial Sequence
  Synthetic oligonucleotide
ccaggaaggaaaagcactgt

SEQ ID NO: 862 - DNA, 20 bp, Artificial Sequence
  Synthetic oligonucleotide
gtggtctgccccttctttta

SEQ ID NO: 863 - DNA, 30 bp, Artificial Sequence
  Synthetic oligonucleotide
tgaagattttgaagctaatacatcccccac

SEQ ID NO: 864 - DNA, 70 bp, Artificial Sequence
  Synthetic oligonucleotide
ccaggaaggaaaagcactgttgaagattttgaagctaatacatcccccactaaaagaaggggcagaccac

SEQ ID NO: 865 - DNA, 20 bp, Artificial Sequence
  Synthetic oligonucleotide
agatgcagaaggcatcttgg

SEQ ID NO: 866 - DNA, 20 bp, Artificial Sequence
  Synthetic oligonucleotide
gctggattgcctctcgtatt

SEQ ID NO: 867 - DNA, 24 bp, Artificial Sequence
  Synthetic oligonucleotide
tggccagctcctctgtatgactgc

SEQ ID NO: 868 - DNA, 74 bp, Artificial Sequence
  Synthetic oligonucleotide
agatgcagaaggcatcttggaggacttgcagtcatacagaggagctggccacgaaatacgagaggcaatccagc

SEQ ID NO: 869 - DNA, 20 bp, Artificial Sequence
  Synthetic oligonucleotide
tgagaaggtgcgctattcaa

SEQ ID NO: 870 - DNA, 20 bp, Artificial Sequence
  Synthetic oligonucleotide
ggccattaaaagctcagtgc

SEQ ID NO: 871 - DNA, 27 bp, Artificial Sequence
  Synthetic oligonucleotide
aagacctcatgcagttactcattcgcc

SEQ ID NO: 872 - DNA, 85 bp, Artificial Sequence
  Synthetic oligonucleotide
tgagaaggtgcgctattcaagtacagagactttagctgaagacctcatgcagttactcattcgccgcactgagcttttaatggcc

SEQ ID NO: 873 - DNA, 19 bp, Artificial Sequence
  Synthetic oligonucleotide
gttggctcacgtgggttac

SEQ ID NO: 874 - DNA, 20 bp, Artificial Sequence
  Synthetic oligonucleotide
gacaggaccgaaacattctg

SEQ ID NO: 875 - DNA, 27 bp, Artificial Sequence
  Synthetic oligonucleotide
agccactgcaaacatactcgttcatca

SEQ ID NO: 876 - DNA, 76 bp, Artificial Sequence
  Synthetic oligonucleotide
gttggctcacgtgggttactgatgaacgagtatgtttgcagtggctaaaaagagtccagaatgtttcggtcctgtc

SEQ ID NO: 877 - DNA, 21 bp, Artificial Sequence
  Synthetic oligonucleotide
ggattgctcaacaaccatgct

SEQ ID NO: 878 - DNA, 24 bp, Artificial Sequence
  Synthetic oligonucleotide
ggcattaacacttttggacgataa

SEQ ID NO: 879 - DNA, 30 bp, Artificial Sequence
  Synthetic oligonucleotide
tctggaccctcctacctctggttcttacgt

SEQ ID NO: 880 - DNA, 91 bp, Artificial Sequence
  Synthetic oligonucleotide
ggattgctcaacaaccatgctgggcatctggaccctcctacctctggttcttacgtctgttgctagattatcgtccaaaagtgttaatgcc

SEQ ID NO: 881 - DNA, 24 bp, Artificial Sequence
  Synthetic oligonucleotide
gcactttgggattctttccattat

SEQ ID NO: 882 - DNA, 24 bp, Artificial Sequence
  Synthetic oligonucleotide
gcatgtaagaagaccctcactgaa

SEQ ID NO: 883 - DNA, 29 bp, Artificial Sequence
  Synthetic oligonucleotide
acaacattctcggtgcctgtaacaaagaa

SEQ ID NO: 884 - DNA, 80 bp, Artificial Sequence
  Synthetic oligonucleotide
gcactttgggattctttccattatgattctttgttacaggcaccgagaatgttgtattcagtgagggtcttcttacatgc

SEQ ID NO: 885 - DNA, 18 bp, Artificial Sequence
  Synthetic oligonucleotide
gcctcttcctgttcgacg

SEQ ID NO: 886 - DNA, 18 bp, Artificial Sequence
  Synthetic oligonucleotide
gctttgcccggtagctct

SEQ ID NO: 887 - DNA, 24 bp, Artificial Sequence
  Synthetic oligonucleotide
tcgcccacctacgtactggcctac

SEQ ID NO: 888 - DNA, 66 bp, Artificial Sequence
  Synthetic oligonucleotide
gcctcttcctgttcgacggctcgcccacctacgtactggcctacacccagagctaccgggcaaagc

SEQ ID NO: 889 - DNA, 20 bp, Artificial Sequence
  Synthetic oligonucleotide
gtctccagtggaagggaaaa

SEQ ID NO: 890 - DNA, 21 bp, Artificial Sequence
  Synthetic oligonucleotide
aggaatgcagctactcactgg

SEQ ID NO: 891 - DNA, 24 bp, Artificial Sequence
  Synthetic oligonucleotide
cccatgatcttcaagcagggaagc

SEQ ID NO: 892 - DNA, 67 bp, Artificial Sequence
  Synthetic oligonucleotide
gtctccagtggaagggaaaagcccatgatcttcaagcagggaagccccagtgagtagctgcattcct

SEQ ID NO: 893 - DNA, 19 bp, Artificial Sequence
  Synthetic oligonucleotide
tcttccgtccctgtcacct

SEQ ID NO: 894 - DNA, 19 bp, Artificial Sequence
  Synthetic oligonucleotide
agagttggtggcctctggt

SEQ ID NO: 895 - DNA, 24 bp, Artificial Sequence
  Synthetic oligonucleotide
acaccatgtcctgaccaagggctt

SEQ ID NO: 896 - DNA, 66 bp, Artificial Sequence
  Synthetic oligonucleotide
tcttccgtccctgtcacctgccaagcccttggtcaggacatggtgtcaccagaggccaccaactct

SEQ ID NO: 897 - DNA, 20 bp, Artificial Sequence
  Synthetic oligonucleotide
ggtggctgtcctcaaaatct

SEQ ID NO: 898 - DNA, 20 bp, Artificial Sequence
  Synthetic oligonucleotide
tctagccaggaggagtttgg

SEQ ID NO: 899 - DNA, 24 bp, Artificial Sequence
  Synthetic oligonucleotide
ttctcggatctccctcagtctgcc

SEQ ID NO: 900 - DNA, 74 bp, Artificial Sequence
  Synthetic oligonucleotide
ggtggctgtcctcaaaatctgcttctcggatctccctcagtctgcccccagcccccaaactcctcctggctaga

SEQ ID NO: 901 - DNA, 18 bp, Artificial Sequence
  Synthetic oligonucleotide
gcatcggtttccatctgc

SEQ ID NO: 902 - DNA, 20 bp, Artificial Sequence
  Synthetic oligonucleotide
aacatattggcttcgtggga

SEQ ID NO: 903 - DNA, 24 bp, Artificial Sequence
  Synthetic oligonucleotide
ccattgactttgccatccgggtag

SEQ ID NO: 904 - DNA, 67 bp, Artificial Sequence
  Synthetic oligonucleotide
gcatcggtttccatctgcagatctacccggatggcaaagtcaatggatcccacgaagccaatatgtt

SEQ ID NO: 905 - DNA, 20 bp, Artificial Sequence
  Synthetic oligonucleotide
gggccattaattctgaccac

SEQ ID NO: 906 - DNA, 19 bp, Artificial Sequence
  Synthetic oligonucleotide
cccgggacatagtgatgaa

SEQ ID NO: 907 - DNA, 23 bp, Artificial Sequence
  Synthetic oligonucleotide
catccaccttgcctctcaggcac

SEQ ID NO: 908 - DNA, 80 bp, Artificial Sequence
  Synthetic oligonucleotide
gggccattaattctgaccacgtgcctgagaggcaaggtggatggccctgggacagaaactgttcatcactatgtcccggg

SEQ ID NO: 909 - DNA, 20 bp, Artificial Sequence
  Synthetic oligonucleotide
ccagagcaaatggctacaaa

SEQ ID NO: 910 - DNA, 20 bp, Artificial Sequence
  Synthetic oligonucleotide
tcccctccttccatgtaatc

SEQ ID NO: 911 - DNA, 24 bp, Artificial Sequence
  Synthetic oligonucleotide
cagccctgagcgacacacaagaag

SEQ ID NO: 912 - DNA, 80 bp, Artificial Sequence
  Synthetic oligonucleotide
ccagagcaaatggctacaaatgtgaactgttccagccctgagcgacacacaagaagttatgattacatggaaggagggga

SEQ ID NO: 913 - DNA, 19 bp, Artificial Sequence
  Synthetic oligonucleotide
gagggactgttggcatgca

SEQ ID NO: 914 - DNA, 25 bp, Artificial Sequence
  Synthetic oligonucleotide
gagtgagaattcgatccaagtcttc

SEQ ID NO: 915 - DNA, 27 bp, Artificial Sequence
  Synthetic oligonucleotide
tcccagagaccaacgttcaagcagttg

SEQ ID NO: 916 - DNA, 80 bp, Artificial Sequence
  Synthetic oligonucleotide
gagggactgttggcatgcagtgccctcccagagaccaacgttcaagcagttggtagaagacttggatcgaattctcactc

SEQ ID NO: 917 - DNA, 20 bp, Artificial Sequence
  Synthetic oligonucleotide
ctggcttaaggatggacagg

SEQ ID NO: 918 - DNA, 20 bp, Artificial Sequence
  Synthetic oligonucleotide
acgagactccagtgctgatg

SEQ ID NO: 919 - DNA, 23 bp, Artificial Sequence
  Synthetic oligonucleotide
cctttcatggggagaaccgcatt

SEQ ID NO: 920 - DNA, 81 bp, Artificial Sequence
  Synthetic oligonucleotide
ctggcttaaggatggacaggcctttcatggggagaaccgcattggaggcattcggctgcgccatcagcactggagtctcgt

SEQ ID NO: 921 - DNA, 20 bp, Artificial Sequence
  Synthetic oligonucleotide
cccacagtagaggggtctca

SEQ ID NO: 922 - DNA, 20 bp, Artificial Sequence
  Synthetic oligonucleotide
ggttctggctttcacgtctg

SEQ ID NO: 923 - DNA, 24 bp, Artificial Sequence
  Synthetic oligonucleotide
tctccccagttccacagcagtgtc

SEQ ID NO: 924 - DNA, 67 bp, Artificial Sequence
  Synthetic oligonucleotide
cccacagtagaggggtctcatgtctccccagttccacagcagtgtcacagacgtgaaagccagaacc

SEQ ID NO: 925 - DNA, 18 bp, Artificial Sequence
  Synthetic oligonucleotide
gaacctgcggtggacact

SEQ ID NO: 926 - DNA, 18 bp, Artificial Sequence
  Synthetic oligonucleotide
gaagacaccctggccctc

SEQ ID NO: 927 - DNA, 24 bp, Artificial Sequence
  Synthetic oligonucleotide
taccaggcccatagcactggacac

SEQ ID NO: 928 - DNA, 66 bp, Artificial Sequence
  Synthetic oligonucleotide
gaacctgcggtggacacttccggtgtccagtgctatgggcctggtattgagggccagggtgtcttc

SEQ ID NO: 929 - DNA, 19 bp, Artificial Sequence
  Synthetic oligonucleotide
caggacaatggtgatggct

SEQ ID NO: 930 - DNA, 19 bp, Artificial Sequence
  Synthetic oligonucleotide
tgatggtgtactcgccagg

SEQ ID NO: 931 - DNA, 24 bp, Artificial Sequence
  Synthetic oligonucleotide
atgtgctgtcagctacctgcccac

SEQ ID NO: 932 - DNA, 67 bp, Artificial Sequence
  Synthetic oligonucleotide
caggacaatggtgatggctcatgtgctgtcagctacctgcccacggagcctggcgagtacaccatca

SEQ ID NO: 933 - DNA, 20 bp, Artificial Sequence
  Synthetic oligonucleotide
ggctcctgaatctatctttg

SEQ ID NO: 934 - DNA, 20 bp, Artificial Sequence
  Synthetic oligonucleotide
tcccacagcaatactccgta

SEQ ID NO: 935 - DNA, 24 bp, Artificial Sequence
  Synthetic oligonucleotide
ctacagcaccaagagcgacgtgtg

SEQ ID NO: 936 - DNA, 75 bp, Artificial Sequence
  Synthetic oligonucleotide
ggctcctgaatctatctttgacaaaatctacagcaccaagagcgacgtgtggtcttacggagtattgctgtggga

SEQ ID NO: 937 - DNA, 20 bp, Artificial Sequence
  Synthetic oligonucleotide
accaagaagctgaggacctg

SEQ ID NO: 938 - DNA, 20 bp, Artificial Sequence
  Synthetic oligonucleotide
cctggaagctgtagcagaca

SEQ ID NO: 939 - DNA, 23 bp, Artificial Sequence
  Synthetic oligonucleotide
agcccgctgaccatggaagatct

SEQ ID NO: 940 - DNA, 69 bp, Artificial Sequence
  Synthetic oligonucleotide
accaagaagctgaggacctgtggctgagcccgctgaccatggaagatcttgtctgctacagcttccagg

SEQ ID NO: 941 - DNA, 21 bp, Artificial Sequence
  Synthetic oligonucleotide
ggaagtgacagacgtgaaggt

SEQ ID NO: 942 - DNA, 18 bp, Artificial Sequence
  Synthetic oligonucleotide
acacggtagccggtcact

SEQ ID NO: 943 - DNA, 24 bp, Artificial Sequence
  Synthetic oligonucleotide
actctcaggcggtgtccacatgat

SEQ ID NO: 944 - DNA, 69 bp, Artificial Sequence
  Synthetic oligonucleotide
ggaagtgacagacgtgaaggtcaccatcatgtggacaccgcctgagagtgcagtgaccggctaccgtgt

SEQ ID NO: 945 - DNA, 21 bp, Artificial Sequence
  Synthetic oligonucleotide
cgagccctttgatgacttcct

SEQ ID NO: 946 - DNA, 18 bp, Artificial Sequence
  Synthetic oligonucleotide
ggagcgggctgtctcaga

SEQ ID NO: 947 - DNA, 22 bp, Artificial Sequence
  Synthetic oligonucleotide
tcccagcatcatccaggcccag

SEQ ID NO: 948 - DNA, 67 bp, Artificial Sequence
  Synthetic oligonucleotide
cgagccctttgatgacttcctgttcccagcatcatccaggcccagtggctctgagacagcccgctcc

SEQ ID NO: 949 - DNA, 18 bp, Artificial Sequence
  Synthetic oligonucleotide
gtaagcaccatgccccac

SEQ ID NO: 950 - DNA, 18 bp, Artificial Sequence
  Synthetic oligonucleotide
ggggcagaggcacttgta

SEQ ID NO: 951 - DNA, 24 bp, Artificial Sequence
  Synthetic oligonucleotide
tatgaaccgcctgacccaagtgaa

SEQ ID NO: 952 - DNA, 76 bp, Artificial Sequence
  Synthetic oligonucleotide
gtaagcaccatgccccacacctcgggtatgaaccgcctgacccaagtgaagacacctgtacaagtgcctctgcccc

SEQ ID NO: 953 - DNA, 18 bp, Artificial Sequence
  Synthetic oligonucleotide
ctgtttgctgtccggagg

SEQ ID NO: 954 - DNA, 20 bp, Artificial Sequence
  Synthetic oligonucleotide
gtggaggaactctgggaatg

SEQ ID NO: 955 - DNA, 24 bp, Artificial Sequence
  Synthetic oligonucleotide
tgtttccatggctaccccacaggt

SEQ ID NO: 956 - DNA, 66 bp, Artificial Sequence
  Synthetic oligonucleotide
ctgtttgctgtccggaggcacctgtggggtagccatggaaacagcacattcccagagttcctccac

SEQ ID NO: 957 - DNA, 20 bp, Artificial Sequence
  Synthetic oligonucleotide
tgtttttgtcgcaacttcca

SEQ ID NO: 958 - DNA, 22 bp, Artificial Sequence
  Synthetic oligonucleotide
tggaaaggttccctgatgtact

SEQ ID NO: 959 - DNA, 24 bp, Artificial Sequence
  Synthetic oligonucleotide
tgatttatgtcccttccctccccc

SEQ ID NO: 960 - DNA, 70 bp, Artificial Sequence
  Synthetic oligonucleotide
tgtttttgtcgcaacttccattgatttatgtcccttccctcccccctaagtacatcagggaacctttcca

SEQ ID NO: 961 - DNA, 20 bp, Artificial Sequence
  Synthetic oligonucleotide
aggcctcctgtccttctaca

SEQ ID NO: 962 - DNA, 21 bp, Artificial Sequence
  Synthetic oligonucleotide
tgtgtgaacctggtcttgaaa

SEQ ID NO: 963 - DNA, 22 bp, Artificial Sequence
  Synthetic oligonucleotide
cgcaccaaacaagtgctgcaca

SEQ ID NO: 964 - DNA, 69 bp, Artificial Sequence
  Synthetic oligonucleotide
aggcctcctgtccttctacaatgcccgcaccaaacaagtgctgcacactttcaagaccaggttcacaca

SEQ ID NO: 965 - DNA, 20 bp, Artificial Sequence
  Synthetic oligonucleotide
gaagcgcagatcatgaagaa

SEQ ID NO: 966 - DNA, 20 bp, Artificial Sequence
  Synthetic oligonucleotide
ctcctcagacaccactgcat

SEQ ID NO: 967 - DNA, 24 bp, Artificial Sequence
  Synthetic oligonucleotide
ctgaagcacgacaagctggtccag

SEQ ID NO: 968 - DNA, 69 bp, Artificial Sequence
  Synthetic oligonucleotide
gaagcgcagatcatgaagaagctgaagcacgacaagctggtccagctctatgcagtggtgtctgaggag

SEQ ID NO: 969 - DNA, 18 bp, Artificial Sequence
  Synthetic oligonucleotide
aatctgcctgtggccttg

SEQ ID NO: 970 - DNA, 19 bp, Artificial Sequence
  Synthetic oligonucleotide
cgagatgttgctggtgaca

SEQ ID NO: 971 - DNA, 24 bp, Artificial Sequence
  Synthetic oligonucleotide
ccagcctcagtgccacttgacatt

SEQ ID NO: 972 - DNA, 68 bp, Artificial Sequence
  Synthetic oligonucleotide
aatctgcctgtggccttgcccgccagcctcagtgccacttgacattccttgtcaccagcaacatctcg

SEQ ID NO: 973 - DNA, 20 bp, Artificial Sequence
  Synthetic oligonucleotide
ccactgtcctgacaatgacc

SEQ ID NO: 974 - DNA, 20 bp, Artificial Sequence
  Synthetic oligonucleotide
gagatccatcgctgtgacat

SEQ ID NO: 975 - DNA, 22 bp, Artificial Sequence
  Synthetic oligonucleotide
ctcagcaccattgcccggaaat

SEQ ID NO: 976 - DNA, 83 bp, Artificial Sequence
  Synthetic oligonucleotide
ccactgtcctgacaatgaccaccctcagcaccattgcccggaaatcgctccccaaggtctcctatgtcacagcgatggatctc

SEQ ID NO: 977 - DNA, 18 bp, Artificial Sequence
  Synthetic oligonucleotide
gtgctggtgacgaatcca

SEQ ID NO: 978 - DNA, 20 bp, Artificial Sequence
  Synthetic oligonucleotide
cccggcaaaaacaaataagt

SEQ ID NO: 979 - DNA, 25 bp, Artificial Sequence
  Synthetic oligonucleotide
ttcatctcaatggaaggatcctgcc

SEQ ID NO: 980 - DNA, 73 bp, Artificial Sequence
  Synthetic oligonucleotide
gtgctggtgacgaatccacattcatctcaatggaaggatcctgccttaagtcaacttatttgtttttgccggg

SEQ ID NO: 981 - DNA, 20 bp, Artificial Sequence
  Synthetic oligonucleotide
accctcgacaagaccacact

SEQ ID NO: 982 - DNA, 20 bp, Artificial Sequence
  Synthetic oligonucleotide
tgggagttcatgggtacaga

SEQ ID NO: 983 - DNA, 20 bp, Artificial Sequence
  Synthetic oligonucleotide
tgggagttcatgggtacaga

SEQ ID NO: 984 - DNA, 70 bp, Artificial Sequence
  Synthetic oligonucleotide
accctcgacaagaccacactttgggacttgggagctggggctgaagttgctctgtacccatgaactccca

SEQ ID NO: 985 - DNA, 21 bp, Artificial Sequence
  Synthetic oligonucleotide
cgctccagacctatgatgact

SEQ ID NO: 986 - DNA, 20 bp, Artificial Sequence
  Synthetic oligonucleotide
acagtggaaggaccaggact

SEQ ID NO: 987 - DNA, 24 bp, Artificial Sequence
  Synthetic oligonucleotide
tgttagccaaagactgccactgca

SEQ ID NO: 988 - DNA, 72 bp, Artificial Sequence
  Synthetic oligonucleotide
cgctccagacctatgatgacttgttagccaaagactgccactgcatatgagcagtcctggtccttccactgt

SEQ ID NO: 989 - DNA, 18 bp, Artificial Sequence
  Synthetic oligonucleotide
ccacctcccacaggttca

SEQ ID NO: 990 - DNA, 18 bp, Artificial Sequence
  Synthetic oligonucleotide
ggtgcgtgcctgtagtcc

SEQ ID NO: 991 - DNA, 24 bp, Artificial Sequence
  Synthetic oligonucleotide
cgtgcctcagcctcctgagtagct

SEQ ID NO: 992 - DNA, 70 bp, Artificial Sequence
  Synthetic oligonucleotide
ccacctcccacaggttcaggcgattcccgtgcctcagcctcctgagtagctgggactacaggcacgcacc

SEQ ID NO: 993 - DNA, 18 bp, Artificial Sequence
  Synthetic oligonucleotide
ggattcacatcgcggaaa

SEQ ID NO: 994 - DNA, 22 bp, Artificial Sequence
  Synthetic oligonucleotide
gttcttgcataacaatccggtc

SEQ ID NO: 995 - DNA, 24 bp, Artificial Sequence
  Synthetic oligonucleotide
ccctgctcacatgcctcacatgat

SEQ ID NO: 996 - DNA, 67 bp, Artificial Sequence
  Synthetic oligonucleotide
ggattcacatcgcggaaagtccctgctcacatgcctcacatgattgaccggattgttatgcaagaac

SEQ ID NO: 997 - DNA, 20 bp, Artificial Sequence
  Synthetic oligonucleotide
aagggctaaatccaggtgtg

SEQ ID NO: 998 - DNA, 19 bp, Artificial Sequence
  Synthetic oligonucleotide
ctggatctctgtggctggt

SEQ ID NO: 999 - DNA, 24 bp, Artificial Sequence
  Synthetic oligonucleotide
tcctgtccttcactgtccttgcca

SEQ ID NO: 1000 - DNA, 81 bp, Artificial Sequence
  Synthetic oligonucleotide
aagggctaaatccaggtgtgacggtatctaatgatgtcctgtccttcactgtccttgccatcaccagccacagagatccag

SEQ ID NO: 1001 - DNA, 18 bp, Artificial Sequence
  Synthetic oligonucleotide
atgtgcttggagtggcct

SEQ ID NO: 1002 - DNA, 21 bp, Artificial Sequence
  Synthetic oligonucleotide
tgtagaacataaacacgggca

SEQ ID NO: 1003 - DNA, 24 bp, Artificial Sequence
  Synthetic oligonucleotide
cgctgagaaaccaaacacacccag

SEQ ID NO: 1004 - DNA, 66 bp, Artificial Sequence
  Synthetic oligonucleotide
atgtgcttggagtggcctggctgggtgtgtttggtttctcagcggtgcccgtgtttatgttctaca

SEQ ID NO: 1005 - DNA, 19 bp, Artificial Sequence
  Synthetic oligonucleotide
cagcctcgcctttaaggat

SEQ ID NO: 1006 - DNA, 20 bp, Artificial Sequence
  Synthetic oligonucleotide
tgacaaatatggccaagcag

SEQ ID NO: 1007 - DNA, 24 bp, Artificial Sequence
  Synthetic oligonucleotide
caaacagtgccctgatctccgttg

SEQ ID NO: 1008 - DNA, 66 bp, Artificial Sequence
  Synthetic oligonucleotide
cagcctcgcctttaaggatggcaaacagtgccctgatctccgttggctgcttggccatatttgtca

SEQ ID NO: 1009 - DNA, 18 bp, Artificial Sequence
  Synthetic oligonucleotide
caaggaccagatccagcg

SEQ ID NO: 1010 - DNA, 18 bp, Artificial Sequence
  Synthetic oligonucleotide
ggtagggcaggaagcagg

SEQ ID NO: 1011 - DNA, 24 bp, Artificial Sequence
  Synthetic oligonucleotide
ctcagcaccgtggtcatcttcctg

SEQ ID NO: 1012 - DNA, 68 bp, Artificial Sequence
  Synthetic oligonucleotide
caaggaccagatccagcggctggtgctcagcaccgtggtcatcttcctggcctgcttcctgccctacc

SEQ ID NO: 1013 - DNA, 20 bp, Artificial Sequence
  Synthetic oligonucleotide
agtacaagcaggctgccaag

SEQ ID NO: 1014 - DNA, 19 bp, Artificial Sequence
  Synthetic oligonucleotide
gcagctcagggaagtcaca

SEQ ID NO: 1015 - DNA, 24 bp, Artificial Sequence
  Synthetic oligonucleotide
cctcctgctggcttcctttgatca

SEQ ID NO: 1016 - DNA, 66 bp, Artificial Sequence
  Synthetic oligonucleotide
agtacaagcaggctgccaagtgcctcctgctggcttcctttgatcactgtgacttccctgagctgc

SEQ ID NO: 1017 - DNA, 20 bp, Artificial Sequence
  Synthetic oligonucleotide
ccatctgcatccatcttgtt

SEQ ID NO: 1018 - DNA, 20 bp, Artificial Sequence
  Synthetic oligonucleotide
ggccaccagggtattatctg

SEQ ID NO: 1019 - DNA, 23 bp, Artificial Sequence
  Synthetic oligonucleotide
ctccccacccttgagaagtgcct

SEQ ID NO: 1020 - DNA, 67 bp, Artificial Sequence
  Synthetic oligonucleotide
ccatctgcatccatcttgtttgggctccccacccttgagaagtgcctcagataataccctggtggcc

SEQ ID NO: 1021 - DNA, 18 bp, Artificial Sequence
  Synthetic oligonucleotide
gtgtgggcaaggacaagc

SEQ ID NO: 1022 - DNA, 19 bp, Artificial Sequence
  Synthetic oligonucleotide
gacctgatttggcctcacc

SEQ ID NO: 1023 - DNA, 24 bp, Artificial Sequence
  Synthetic oligonucleotide
tccaccctccctttctcactccac

SEQ ID NO: 1024 - DNA, 68 bp, Artificial Sequence
  Synthetic oligonucleotide
gtgtgggcaaggacaagcaggatagtggagtgagaaagggagggtggagggtgaggccaaatcaggtc

SEQ ID NO: 1025 - DNA, 18 bp, Artificial Sequence
  Synthetic oligonucleotide
gacaaggacggcagcaag

SEQ ID NO: 1026 - DNA, 18 bp, Artificial Sequence
  Synthetic oligonucleotide
ttgtggcctgtctggacc

SEQ ID NO: 1027 - DNA, 24 bp, Artificial Sequence
  Synthetic oligonucleotide
ccaggagttgccaccactgttgtc

SEQ ID NO: 1028 - DNA, 66 bp, Artificial Sequence
  Synthetic oligonucleotide
gacaaggacggcagcaaggtgacaacagtggtggcaactcctgggcagggtccagacaggccacaa

SEQ ID NO: 1029 - DNA, 22 bp, Artificial Sequence
  Synthetic oligonucleotide
cttctgctaagcggtacatcga

SEQ ID NO: 1030 - DNA, 20 bp, Artificial Sequence
  Synthetic oligonucleotide
ggctcaaagccttgcttcac

SEQ ID NO: 1031 - DNA, 21 bp, Artificial Sequence
  Synthetic oligonucleotide
acccagccaatcgggatcggc

SEQ ID NO: 1032 - DNA, 85 bp, Artificial Sequence
  Synthetic oligonucleotide
cttctgctaagcggtacatcgagacggacccagccaatcgggatcggcggacgcccatcaccgtggtgaagcaaggctttgagcc

SEQ ID NO: 1033 - DNA, 27 bp, Artificial Sequence
  Synthetic oligonucleotide
aagctatgaggaaaagaagtacacgat

SEQ ID NO: 1034 - DNA, 20 bp, Artificial Sequence
  Synthetic oligonucleotide
ggcccagcttgaatttttca

SEQ ID NO: 1035 - DNA, 30 bp, Artificial Sequence
  Synthetic oligonucleotide
tcagccactggcttctgtcataatcaggag

SEQ ID NO: 1036 - DNA, 86 bp, Artificial Sequence
  Synthetic oligonucleotide
aagctatgaggaaaagaagtacacgatgggggacgctcctgattatgacagaagccagtggctgaatgaaaaattcaagctgggcc

SEQ ID NO: 1037 - DNA, 20 bp, Artificial Sequence
  Synthetic oligonucleotide
ctgcaggcactccctgaaat

SEQ ID NO: 1038 - DNA, 20 bp, Artificial Sequence
  Synthetic oligonucleotide
ccaagaaaccatggctgctt

SEQ ID NO: 1039 - DNA, 26 bp, Artificial Sequence
  Synthetic oligonucleotide
ctgaagctctactcacagtttctggg

SEQ ID NO: 1040 - DNA, 68 bp, Artificial Sequence
  Synthetic oligonucleotide
ctgcaggcactccctgaaatgctgaagctctactcacagtttctggggaagcagccatggtttcttgg

SEQ ID NO: 1041 - DNA, 27 bp, Artificial Sequence
  Synthetic oligonucleotide
caagtaccacagcgatgactacattaa

SEQ ID NO: 1042 - DNA, 22 bp, Artificial Sequence
  Synthetic oligonucleotide
gcttgctgtactccgacatgtt

SEQ ID NO: 1043 - DNA, 23 bp, Artificial Sequence
  Synthetic oligonucleotide
ttcttgcgctccatccgtccaga

SEQ ID NO: 1044 - DNA, 74 bp, Artificial Sequence
  Synthetic oligonucleotide
caagtaccacagcgatgactacattaaattcttgcgctccatccgtccagataacatgtcggagtacagcaagc

SEQ ID NO: 1045 - DNA, 20 bp, Artificial Sequence
  Synthetic oligonucleotide
aaccaggcagtcaccttgag

SEQ ID NO: 1046 - DNA, 19 bp, Artificial Sequence
  Synthetic oligonucleotide
ctctgtcttcctgcatcgc

SEQ ID NO: 1047 - DNA, 24 bp, Artificial Sequence
  Synthetic oligonucleotide
ccccctgaagctcttcctctgctt

SEQ ID NO: 1048 - DNA, 69 bp, Artificial Sequence
  Synthetic oligonucleotide
aaccaggcagtcaccttgaggaagcagaggaagagcttcagggggaccaggcgatgcaggaagacagag

SEQ ID NO: 1049 - DNA, 20 bp, Artificial Sequence
  Synthetic oligonucleotide
ctcaggtctgcccctacaat

SEQ ID NO: 1050 - DNA, 19 bp, Artificial Sequence
  Synthetic oligonucleotide
ttattggtgctccgtggac

SEQ ID NO: 1051 - DNA, 24 bp, Artificial Sequence
  Synthetic oligonucleotide
ctgagcagctctcaggatcggctt

SEQ ID NO: 1052 - DNA, 76 bp, Artificial Sequence
  Synthetic oligonucleotide
ctcaggtctgcccctacaatctctatgctgagcagctctcaggatcggctttcacttgtccacggagcaccaataa

SEQ ID NO: 1053 - DNA, 18 bp, Artificial Sequence
  Synthetic oligonucleotide
ctcagagccccacctgag

SEQ ID NO: 1054 - DNA, 19 bp, Artificial Sequence
  Synthetic oligonucleotide
gggtttccctgccatactg

SEQ ID NO: 1055 - DNA, 24 bp, Artificial Sequence
  Synthetic oligonucleotide
cgactcactgaccgaggcctgtaa

SEQ ID NO: 1056 - DNA, 67 bp, Artificial Sequence
  Synthetic oligonucleotide
ctcagagccccacctgagcctgccgactcactgaccgaggcctgtaagcagtatggcagggaaaccc

SEQ ID NO: 1057 - DNA, 19 bp, Artificial Sequence
  Synthetic oligonucleotide
ggatgaggaaaagggggat

SEQ ID NO: 1058 - DNA, 20 bp, Artificial Sequence
  Synthetic oligonucleotide
tccctagctgactttctccg

SEQ ID NO: 1059 - DNA, 24 bp, Artificial Sequence
  Synthetic oligonucleotide
ccattgctcctggttctgggtttc

SEQ ID NO: 1060 - DNA, 66 bp, Artificial Sequence
  Synthetic oligonucleotide
ggatgaggaaaagggggattggaaacccagaaccaggagcaatggccggagaaagtcagctaggga

SEQ ID NO: 1061 - DNA, 18 bp, Artificial Sequence
  Synthetic oligonucleotide
tacgcacagaggcaagca

SEQ ID NO: 1062 - DNA, 20 bp, Artificial Sequence
  Synthetic oligonucleotide
gagagaagtgctggagaggc

SEQ ID NO: 1063 - DNA, 24 bp, Artificial Sequence
  Synthetic oligonucleotide
taagagtccgggatccccagccta

SEQ ID NO: 1064 - DNA, 66 bp, Artificial Sequence
  Synthetic oligonucleotide
tacgcacagaggcaagcagctaagagtccgggatccccagcctactgcctctccagcacttctctc

SEQ ID NO: 1065 - DNA, 20 bp, Artificial Sequence
  Synthetic oligonucleotide
ccatccccatcatgggtatc

SEQ ID NO: 1066 - DNA, 20 bp, Artificial Sequence
  Synthetic oligonucleotide
ccgcagctccagtgactaca

SEQ ID NO: 1067 - DNA, 24 bp, Artificial Sequence
  Synthetic oligonucleotide
ctgcaaggacaaccaggccagcaa

SEQ ID NO: 1068 - DNA, 70 bp, Artificial Sequence
  Synthetic oligonucleotide
cctgcgcggctactacaaccagagcgaggccagttctcacaccctccagtggatgattggctgcgacctg

SEQ ID NO: 1069 - DNA, 19 bp, Artificial Sequence
  Synthetic oligonucleotide
caccctgcaggtgtctgag

SEQ ID NO: 1070 - DNA, 22 bp, Artificial Sequence
  Synthetic oligonucleotide
ggtacctaggagcagaaggtga

SEQ ID NO: 1071 - DNA, 24 bp, Artificial Sequence
  Synthetic oligonucleotide
taagtgatctgccctccaggtggc

SEQ ID NO: 1072 - DNA, 69 bp, Artificial Sequence
  Synthetic oligonucleotide
caccctgcaggtgtctgagactaagtgatctgccctccaggtggcgatcaccttctgctcctaggtacc

SEQ ID NO: 1073 - DNA, 19 bp, Artificial Sequence
  Synthetic oligonucleotide
tcccagcatctcaacaagg

SEQ ID NO: 1074 - DNA, 20 bp, Artificial Sequence
  Synthetic oligonucleotide
cgtaccaggtgtacagagcg

SEQ ID NO: 1075 - DNA, 24 bp, Artificial Sequence
  Synthetic oligonucleotide
cccctatgaagacccagaagcgtg

SEQ ID NO: 1076 - DNA, 67 bp, Artificial Sequence
  Synthetic oligonucleotide
tcccagcatctcaacaagggcacccctatgaagacccagaagcgtgccgctctgtacacctggtacg

SEQ ID NO: 1077 - DNA, 19 bp, Artificial Sequence
  Synthetic oligonucleotide
gcggaagctgtatgtgctc

SEQ ID NO: 1078 - DNA, 20 bp, Artificial Sequence
  Synthetic oligonucleotide
ttcggataagatgaccgtcc

SEQ ID NO: 1079 - DNA, 24 bp, Artificial Sequence
  Synthetic oligonucleotide
cagtcaccagcccaaagtgcactt

SEQ ID NO: 1080 - DNA, 77 bp, Artificial Sequence
  Synthetic oligonucleotide
gcggaagctgtatgtgctcaagtacctgtttgaagtgcactttgggctggtgactgtggacggtcatcttatccgaa

SEQ ID NO: 1081 - DNA, 19 bp, Artificial Sequence
  Synthetic oligonucleotide
ggacgaatacgaccccact

SEQ ID NO: 1082 - DNA, 18 bp, Artificial Sequence
  Synthetic oligonucleotide
gcacgtctccccatcaat

SEQ ID NO: 1083 - DNA, 24 bp, Artificial Sequence
  Synthetic oligonucleotide
accacctgcttccggtaggaatcc

SEQ ID NO: 1084 - DNA, 67 bp, Artificial Sequence
  Synthetic oligonucleotide
ggacgaatacgaccccactatagaggattcctaccggaagcaggtggtcattgatggggagacgtgc

SEQ ID NO: 1085 - DNA, 20 bp, Artificial Sequence
  Synthetic oligonucleotide
ccagcgagttcttgatgtga

SEQ ID NO: 1086 - DNA, 18 bp, Artificial Sequence
  Synthetic oligonucleotide
atctcaccagccaccagg

SEQ ID NO: 1087 - DNA, 24 bp, Artificial Sequence
  Synthetic oligonucleotide
tcatgggcaccttcaatgtgatcc

SEQ ID NO: 1088 - DNA, 66 bp, Artificial Sequence
  Synthetic oligonucleotide
ccaccagacaagaccgattcgctggcctccatttcttcaacccagtgcctgtcatgaaacttgtgg

SEQ ID NO: 1089 - DNA, 20 bp, Artificial Sequence
  Synthetic oligonucleotide
gctttccaagtggggaatta

SEQ ID NO: 1090 - DNA, 20 bp, Artificial Sequence
  Synthetic oligonucleotide
tgcctgcgatatttgttagg

SEQ ID NO: 1091 - DNA, 24 bp, Artificial Sequence
  Synthetic oligonucleotide
agttgcttccatccaacctggagg

SEQ ID NO: 1092 - DNA, 68 bp, Artificial Sequence
  Synthetic oligonucleotide
gctttccaagtggggaattaaagttgcttccatccaacctggaggcttcctaacaaatatcgcaggca

SEQ ID NO: 1093 - DNA, 18 bp, Artificial Sequence
  Synthetic oligonucleotide
gggacgtcctggaacagt

SEQ ID NO: 1094 - DNA, 20 bp, Artificial Sequence
  Synthetic oligonucleotide
tggagaatctcacgcacttc

SEQ ID NO: 1095 - DNA, 24 bp, Artificial Sequence
  Synthetic oligonucleotide
cttcatcctcacagggctgctggt

SEQ ID NO: 1096 - DNA, 81 bp, Artificial Sequence
  Synthetic oligonucleotide
gggacgtcctggaacagttcttcatcctcacagggctgctggtgtgcctggcctgcctggcgaagtgcgtgagattctcca

SEQ ID NO: 1097 - DNA, 21 bp, Artificial Sequence
  Synthetic oligonucleotide
cgggaagcttcagagtacctt

SEQ ID NO: 1098 - DNA, 20 bp, Artificial Sequence
  Synthetic oligonucleotide
acctcaggcccaatatcctt

SEQ ID NO: 1099 - DNA, 24 bp, Artificial Sequence
  Synthetic oligonucleotide
aggcggcgtcctatttcctcaaat

SEQ ID NO: 1100 - DNA, 69 bp, Artificial Sequence
  Synthetic oligonucleotide
cgggaagcttcagagtacctttgtatttgaggaaataggacgccgcctaaaggatattgggcctgaggt

SEQ ID NO: 1101 - DNA, 20 bp, Artificial Sequence
  Synthetic oligonucleotide
gccttcctttaaccctgatg

SEQ ID NO: 1102 - DNA, 22 bp, Artificial Sequence
  Synthetic oligonucleotide
ggagtaaattgggctgagtagg

SEQ ID NO: 1103 - DNA, 24 bp, Artificial Sequence
  Synthetic oligonucleotide
acttccagcaggaagccaatccag

SEQ ID NO: 1104 - DNA, 77 bp, Artificial Sequence
  Synthetic oligonucleotide
gccttcctttaaccctgatgtactggattggcttcctgctggaagtagtgagcttcctactcagcccaatttactcc

SEQ ID NO: 1105 - DNA, 20 bp, Artificial Sequence
  Synthetic oligonucleotide
gcattgtgaccagcacctac

SEQ ID NO: 1106 - DNA, 19 bp, Artificial Sequence
  Synthetic oligonucleotide
gaagtgcctgggctttcat

SEQ ID NO: 1107 - DNA, 24 bp, Artificial Sequence
  Synthetic oligonucleotide
atccgctccatattggctgtccag

SEQ ID NO: 1108 - DNA, 66 bp, Artificial Sequence
  Synthetic oligonucleotide
gcattgtgaccagcacctacggctggacagccaatatggagcggatcatgaaagcccaggcacttc

SEQ ID NO: 1109 - DNA, 24 bp, Artificial Sequence
  Synthetic oligonucleotide
ggctagtagaactggatcccaaca

SEQ ID NO: 1110 - DNA, 20 bp, Artificial Sequence
  Synthetic oligonucleotide
ggtctgcccaaatgcttttc

SEQ ID NO: 1111 - DNA, 30 bp, Artificial Sequence
  Synthetic oligonucleotide
taattagacctaggcctcagctgcactgcc

SEQ ID NO: 1112 - DNA, 84 bp, Artificial Sequence
  Synthetic oligonucleotide
ggctagtagaactggatcccaacaccaaactcttaattagacctaggcctcagctgcactgcccgaaaagcatttgggcagacc

SEQ ID NO: 1113 - DNA, 19 bp, Artificial Sequence
  Synthetic oligonucleotide
cctccctctggtggtgctt

SEQ ID NO: 1114 - DNA, 26 bp, Artificial Sequence
  Synthetic oligonucleotide
gctacatctacacttggttggcttaa

SEQ ID NO: 1115 - DNA, 26 bp, Artificial Sequence
  Synthetic oligonucleotide
ctcagggcccaccattgaagaggttg

SEQ ID NO: 1116 - DNA, 73 bp, Artificial Sequence
  Synthetic oligonucleotide
cctccctctggtggtgcttcctcagggcccaccattgaagaggttgattaagccaaccaagtgtagatgtagc

SEQ ID NO: 1117 - DNA, 19 bp, Artificial Sequence
  Synthetic oligonucleotide
ccgactggaggagcataaa

SEQ ID NO: 1118 - DNA, 19 bp, Artificial Sequence
  Synthetic oligonucleotide
atgctggctgactctgctc

SEQ ID NO: 1119 - DNA, 24 bp, Artificial Sequence
  Synthetic oligonucleotide
cgcacttttctgagcagacgtcca

SEQ ID NO: 1120 - DNA, 84 bp, Artificial Sequence
  Synthetic oligonucleotide
ccgactggaggagcataaaagcgcagccgagcccagcgccccgcacttttctgagcagacgtccagagcagagtcagccagcat

SEQ ID NO: 1121 - DNA, 20 bp, Artificial Sequence
  Synthetic oligonucleotide
caccactccagaggtagcag

SEQ ID NO: 1122 - DNA, 20 bp, Artificial Sequence
  Synthetic oligonucleotide
tgggaccaaaccatacattg

SEQ ID NO: 1123 - DNA, 23 bp, Artificial Sequence
  Synthetic oligonucleotide
cacctttcccttcccccaaggat

SEQ ID NO: 1124 - DNA, 73 bp, Artificial Sequence
  Synthetic oligonucleotide
caccactccagaggtagcagcatccttgggggaagggaaaggtgcatggtccacaatgtatggtttggtccca

SEQ ID NO: 1125 - DNA, 20 bp, Artificial Sequence
  Synthetic oligonucleotide
gcaagcaacagtagtcgctg

SEQ ID NO: 1126 - DNA, 21 bp, Artificial Sequence
  Synthetic oligonucleotide
ccaactttcacgctaactggt

SEQ ID NO: 1127 - DNA, 25 bp, Artificial Sequence
  Synthetic oligonucleotide
tctccaccctttcctttagaacccg

SEQ ID NO: 1128 - DNA, 78 bp, Artificial Sequence
  Synthetic oligonucleotide
gcaagcaacagtagtcgctgttggatcgggttctaaaggaaagggtggagagattcaaccagttagcgtgaaagttgg

SEQ ID NO: 1129 - DNA, 20 bp, Artificial Sequence
  Synthetic oligonucleotide
gagtacgtgtgccgagtgtt

SEQ ID NO: 1130 - DNA, 19 bp, Artificial Sequence
  Synthetic oligonucleotide
ctcaatggtgaccaggaca

SEQ ID NO: 1131 - DNA, 23 bp, Artificial Sequence
  Synthetic oligonucleotide
cagctccgtgcctctagaggcct

SEQ ID NO: 1132 - DNA, 66 bp, Artificial Sequence
  Synthetic oligonucleotide
gagtacgtgtgccgagtgttgggcagctccgtgcctctagaggcctctgtcctggtcaccattgag

SEQ ID NO: 1133 - DNA, 24 bp, Artificial Sequence
  Synthetic oligonucleotide
gcagacagtgaccatctacagctt

SEQ ID NO: 1134 - DNA, 22 bp, Artificial Sequence
  Synthetic oligonucleotide
cttctgagacctctggcttcgt

SEQ ID NO: 1135 - DNA, 20 bp, Artificial Sequence
  Synthetic oligonucleotide
ccggcgcccaacgtgattct

SEQ ID NO: 1136 - DNA, 68 bp, Artificial Sequence
  Synthetic oligonucleotide
gcagacagtgaccatctacagctttccggcgcccaacgtgattctgacgaagccagaggtctcagaag

SEQ ID NO: 1137 - DNA, 18 bp, Artificial Sequence
  Synthetic oligonucleotide
gtacctggtgcgcgagag

SEQ ID NO: 1138 - DNA, 19 bp, Artificial Sequence
  Synthetic oligonucleotide
gcgtctccgctgtagtgtt

SEQ ID NO: 1139 - DNA, 24 bp, Artificial Sequence
  Synthetic oligonucleotide
tcaagttgcctcggaagtcccagt

SEQ ID NO: 1140 - DNA, 77 bp, Artificial Sequence
  Synthetic oligonucleotide
gtacctggtgcgcgagagcgtatccccaactgggacttccgaggcaacttgaactcagaacactacagcggagacgc

SEQ ID NO: 1141 - DNA, 20 bp, Artificial Sequence
  Synthetic oligonucleotide
atcccatgaagcccagatac

SEQ ID NO: 1142 - DNA, 20 bp, Artificial Sequence
  Synthetic oligonucleotide
gcaccattcttagtggagca

SEQ ID NO: 1143 - DNA, 27 bp, Artificial Sequence
  Synthetic oligonucleotide
aaaattccaccccatgatcaagaatcc

SEQ ID NO: 1144 - DNA, 69 bp, Artificial Sequence
  Synthetic oligonucleotide
atcccatgaagcccagatacacaaaattccaccccatgatcaagaatcctgctccactaagaatggtgc

SEQ ID NO: 1145 - DNA, 20 bp, Artificial Sequence
  Synthetic oligonucleotide
tgacaaccaagcaaatgtga

SEQ ID NO: 1146 - DNA, 20 bp, Artificial Sequence
  Synthetic oligonucleotide
cagtctgcccatgtggtaat

SEQ ID NO: 1147 - DNA, 24 bp, Artificial Sequence
  Synthetic oligonucleotide
aagttgccccaggtcaccagactc

SEQ ID NO: 1148 - DNA, 76 bp, Artificial Sequence
  Synthetic oligonucleotide
tgacaaccaagcaaatgtgaggagtctggtgacctggggcaactttgcctggatgtattaccacatgggcagactg

SEQ ID NO: 1149 - DNA, 20 bp, Artificial Sequence
  Synthetic oligonucleotide
gctaaaacagggaagcgaaa

SEQ ID NO: 1150 - DNA, 20 bp, Artificial Sequence
  Synthetic oligonucleotide
caaccattactgggatgctc

SEQ ID NO: 1151 - DNA, 26 bp, Artificial Sequence
  Synthetic oligonucleotide
tcgacctcgaaacagcatctgactcc

SEQ ID NO: 1152 - DNA, 69 bp, Artificial Sequence
  Synthetic oligonucleotide
gctaaaacagggaagcgaaaaaggagtcagatgctgtttcgaggtcgaagagcatcccagtaatggttg

SEQ ID NO: 1153 - DNA, 21 bp, Artificial Sequence
  Synthetic oligonucleotide
tccggagctgtgatctaagga

SEQ ID NO: 1154 - DNA, 20 bp, Artificial Sequence
  Synthetic oligonucleotide
cggacagagcgagctgactt

SEQ ID NO: 1155 - DNA, 24 bp, Artificial Sequence
  Synthetic oligonucleotide
tgtattgcgcacccctcaagcctg

SEQ ID NO: 1156 - DNA, 76 bp, Artificial Sequence
  Synthetic oligonucleotide
tccggagctgtgatctaaggaggctggagatgtattgcgcacccctcaagcctgccaagtcagctcgctctgtccg

SEQ ID NO: 1157 - DNA, 21 bp, Artificial Sequence
  Synthetic oligonucleotide
gcatggtagccgaagatttca

SEQ ID NO: 1158 - DNA, 30 bp, Artificial Sequence
  Synthetic oligonucleotide
tttccggtaatagtctgtctcatagatatc

SEQ ID NO: 1159 - DNA, 28 bp, Artificial Sequence
  Synthetic oligonucleotide
cgcgtcataccaaaatctccgattttga

SEQ ID NO: 1160 - DNA, 83 bp, Artificial Sequence
  Synthetic oligonucleotide
gcatggtagccgaagatttcacagtcaaaatcggagattttggtatgacgcgagatatctatgagacagactattaccggaaa

SEQ ID NO: 1161 - DNA, 19 bp, Artificial Sequence
  Synthetic oligonucleotide
ccgtgcttccggacaactt

SEQ ID NO: 1162 - DNA, 20 bp, Artificial Sequence
  Synthetic oligonucleotide
tggactgcttccaggtgtca

SEQ ID NO: 1163 - DNA, 24 bp, Artificial Sequence
  Synthetic oligonucleotide
taccccgtgggcaagttcttccaa

SEQ ID NO: 1164 - DNA, 72 bp, Artificial Sequence
  Synthetic oligonucleotide
ccgtgcttccggacaacttccccagataccccgtgggcaagttcttccaatatgacacctggaagcagtcca

SEQ ID NO: 1165 - DNA, 19 bp, Artificial Sequence
  Synthetic oligonucleotide
gtggacagcaccatgaaca

SEQ ID NO: 1166 - DNA, 20 bp, Artificial Sequence
  Synthetic oligonucleotide
ccttcatacccgacttgagg

SEQ ID NO: 1167 - DNA, 20 bp, Artificial Sequence
  Synthetic oligonucleotide
cttccggccagcactgcctc

SEQ ID NO: 1168 - DNA, 73 bp, Artificial Sequence
  Synthetic oligonucleotide
gtggacagcaccatgaacatgttgggcgggggaggcagtgctggccggaagcccctcaagtcgggtatgaagg

SEQ ID NO: 1169 - DNA, 18 bp, Artificial Sequence
  Synthetic oligonucleotide
acatcccaacgcatgctc

SEQ ID NO: 1170 - DNA, 18 bp, Artificial Sequence
  Synthetic oligonucleotide
ccacgcccttgtttcaga

SEQ ID NO: 1171 - DNA, 24 bp, Artificial Sequence
  Synthetic oligonucleotide
acaccacagaaggctgtgagctcc

SEQ ID NO: 1172 - DNA, 66 bp, Artificial Sequence
  Synthetic oligonucleotide
acatcccaacgcatgctcctggagctcacagccttctgtggtgtcatttctgaaacaagggcgtgg

SEQ ID NO: 1173 - DNA, 22 bp, Artificial Sequence
  Synthetic oligonucleotide
tggacaagtacgggatgaagct

SEQ ID NO: 1174 - DNA, 21 bp, Artificial Sequence
  Synthetic oligonucleotide
cgaaggtgtggcactgaaagt

SEQ ID NO: 1175 - DNA, 24 bp, Artificial Sequence
  Synthetic oligonucleotide
cccgtcaacgtactccatgcctgg

SEQ ID NO: 1176 - DNA, 69 bp, Artificial Sequence
  Synthetic oligonucleotide
tggacaagtacgggatgaagctgccaggcatggagtacgttgacggggactttcagtgccacaccttcg

SEQ ID NO: 1177 - DNA, 20 bp, Artificial Sequence
  Synthetic oligonucleotide
tgaaccgcagagaccaacag

SEQ ID NO: 1178 - DNA, 20 bp, Artificial Sequence
  Synthetic oligonucleotide
gtcttggacacccgcagaat

SEQ ID NO: 1179 - DNA, 25 bp, Artificial Sequence
  Synthetic oligonucleotide
atccaggcacctctaccacgccctc

SEQ ID NO: 1180 - DNA, 77 bp, Artificial Sequence
  Synthetic oligonucleotide
tgaaccgcagagaccaacagaggaatccaggcacctctaccacgccctcccagcccaattctgcgggtgtccaagac

SEQ ID NO: 1181 - DNA, 20 bp, Artificial Sequence
  Synthetic oligonucleotide
ctgaccacgctttctagctg

SEQ ID NO: 1182 - DNA, 21 bp, Artificial Sequence
  Synthetic oligonucleotide
ccaagcccagagacaagataa

SEQ ID NO: 1183 - DNA, 24 bp, Artificial Sequence
  Synthetic oligonucleotide
ttgagctgttttccctgacctccc

SEQ ID NO: 1184 - DNA, 71 bp, Artificial Sequence
  Synthetic oligonucleotide
ctgaccacgctttctagctgttgagctgttttccctgacctccctctaatttatcttgtctctgggcttgg

SEQ ID NO: 1185 - DNA, 20 bp, Artificial Sequence
  Synthetic oligonucleotide
tggaaggttccacaagtcac

SEQ ID NO: 1186 - DNA, 20 bp, Artificial Sequence
  Synthetic oligonucleotide
tcttgaccttgcagctttgt

SEQ ID NO: 1187 - DNA, 26 bp, Artificial Sequence
  Synthetic oligonucleotide
cctgtgatcaacagtacccgtatggg

SEQ ID NO: 1188 - DNA, 66 bp, Artificial Sequence
  Synthetic oligonucleotide
tggaaggttccacaagtcaccctgtgatcaacagtacccgtatgggacaaagctgcaaggtcaaga

SEQ ID NO: 1189 - DNA, 20 bp, Artificial Sequence
  Synthetic oligonucleotide
tcaagcaacactcctagggc

SEQ ID NO: 1190 - DNA, 20 bp, Artificial Sequence
  Synthetic oligonucleotide
cagctcctttctgggttgtg

SEQ ID NO: 1191 - DNA, 24 bp, Artificial Sequence
  Synthetic oligonucleotide
tggcttctgtctgatcaaggcacc

SEQ ID NO: 1192 - DNA, 66 bp, Artificial Sequence
  Synthetic oligonucleotide
tcaagcaacactcctagggcctggcttctgtctgatcaaggcaccacacaacccagaaaggagctg

SEQ ID NO: 1193 - DNA, 22 bp, Artificial Sequence
  Synthetic oligonucleotide
ggtccttggtagagggctactt

SEQ ID NO: 1194 - DNA, 20 bp, Artificial Sequence
  Synthetic oligonucleotide
ggatggagcttcaggagaga

SEQ ID NO: 1195 - DNA, 24 bp, Artificial Sequence
  Synthetic oligonucleotide
tctccaccctggccctgttacagt

SEQ ID NO: 1196 - DNA, 69 bp, Artificial Sequence
  Synthetic oligonucleotide
ggtccttggtagagggctactttactgtaacagggccagggtggagagttctctcctgaagctccatcc

SEQ ID NO: 1197 - DNA, 20 bp, Artificial Sequence
  Synthetic oligonucleotide
agctgaggaagatgctggtt

SEQ ID NO: 1198 - DNA, 20 bp, Artificial Sequence
  Synthetic oligonucleotide
ggaaagaaggtgctcaggtc

SEQ ID NO: 1199 - DNA, 24 bp, Artificial Sequence
  Synthetic oligonucleotide
tgcccacagaccttccaggagaat

SEQ ID NO: 1200 - DNA, 67 bp, Artificial Sequence
  Synthetic oligonucleotide
agctgaggaagatgctggttccctgcccacagaccttccaggagaatgacctgagcaccttctttcc

SEQ ID NO: 1201 - DNA, 20 bp, Artificial Sequence
  Synthetic oligonucleotide
acctcaactcctgccacaat

SEQ ID NO: 1202 - DNA, 22 bp, Artificial Sequence
  Synthetic oligonucleotide
cactgtttgtgacaagtgcaag

SEQ ID NO: 1203 - DNA, 24 bp, Artificial Sequence
  Synthetic oligonucleotide
tgcaactcctgtcttgcattgcac

SEQ ID NO: 1204 - DNA, 79 bp, Artificial Sequence
  Synthetic oligonucleotide
acctcaactcctgccacaatgtacaggatgcaactcctgtcttgcattgcactaagtcttgcacttgtcacaaacagtg

SEQ ID NO: 1205 - DNA, 20 bp, Artificial Sequence
  Synthetic oligonucleotide
cctgaaccttccaaagatgg

SEQ ID NO: 1206 - DNA, 20 bp, Artificial Sequence
  Synthetic oligonucleotide
accaggcaagtctcctcatt

SEQ ID NO: 1207 - DNA, 27 bp, Artificial Sequence
  Synthetic oligonucleotide
ccagattggaagcatccatctttttca

SEQ ID NO: 1208 - DNA, 72 bp, Artificial Sequence
  Synthetic oligonucleotide
cctgaaccttccaaagatggctgaaaaagatggatgcttccaatctggattcaatgaggagacttgcctggt

SEQ ID NO: 1209 - DNA, 20 bp, Artificial Sequence
  Synthetic oligonucleotide
ccagcttatctcaggggtgt

SEQ ID NO: 1210 - DNA, 18 bp, Artificial Sequence
  Synthetic oligonucleotide
ctggcgtagaaccttccg

SEQ ID NO: 1211 - DNA, 24 bp, Artificial Sequence
  Synthetic oligonucleotide
cctttggcttcacggaagagcctt

SEQ ID NO: 1212 - DNA, 67 bp, Artificial Sequence
  Synthetic oligonucleotide
ccagcttatctcaggggtgtgcggcctttggcttcacggaagagccttgcggaaggttctacgccag

SEQ ID NO: 1213 - DNA, 20 bp, Artificial Sequence
  Synthetic oligonucleotide
ggcctaatgttccagatcct

SEQ ID NO: 1214 - DNA, 20 bp, Artificial Sequence
  Synthetic oligonucleotide
aaaattgtgccttggaggag

SEQ ID NO: 1215 - DNA, 25 bp, Artificial Sequence
  Synthetic oligonucleotide
catattgcccagtggtcacctcaca

SEQ ID NO: 1216 - DNA, 74 bp, Artificial Sequence
  Synthetic oligonucleotide
ggcctaatgttccagatccttcaaagagtcatattgcccagtggtcacctcacactcctccaaggcacaatttt

SEQ ID NO: 1217 - DNA, 26 bp, Artificial Sequence
  Synthetic oligonucleotide
aaggaaccatctcactgtgtgtaaac

SEQ ID NO: 1218 - DNA, 20 bp, Artificial Sequence
  Synthetic oligonucleotide
atcaggaaggctgccaagag

SEQ ID NO: 1219 - DNA, 22 bp, Artificial Sequence
  Synthetic oligonucleotide
tgacttccaagctggccgtggc

SEQ ID NO: 1220 - DNA, 70 bp, Artificial Sequence
  Synthetic oligonucleotide
aaggaaccatctcactgtgtgtaaacatgacttccaagctggccgtggctctcttggcagccttcctgat

SEQ ID NO: 1221 - DNA, 18 bp, Artificial Sequence
  Synthetic oligonucleotide
gacacgccaagtggttcc

SEQ ID NO: 1222 - DNA, 19 bp, Artificial Sequence
  Synthetic oligonucleotide
ctcaagacccggatcacaa

SEQ ID NO: 1223 - DNA, 24 bp, Artificial Sequence
  Synthetic oligonucleotide
acacaagacttcagcccgttggct

SEQ ID NO: 1224 - DNA, 70 bp, Artificial Sequence
  Synthetic oligonucleotide
gacacgccaagtggttccaggccagagccaacgggctgaagtcttgtgtcattgtgatccgggtcttgag

SEQ ID NO: 1225 - DNA, 20 bp, Artificial Sequence
  Synthetic oligonucleotide
ctcaggattttctcgcatcc

SEQ ID NO: 1226 - DNA, 19 bp, Artificial Sequence
  Synthetic oligonucleotide
aggagcaggtggagactgg

SEQ ID NO: 1227 - DNA, 24 bp, Artificial Sequence
  Synthetic oligonucleotide
atgtgctcccagtgctaggtgcct

SEQ ID NO: 1228 - DNA, 66 bp, Artificial Sequence
  Synthetic oligonucleotide
ctcaggattttctcgcatccaaatgtgctcccagtgctaggtgcctgccagtctccacctgctcct

SEQ ID NO: 1229 - DNA, 20 bp, Artificial Sequence
  Synthetic oligonucleotide
ctgcctatgccagactcaga

SEQ ID NO: 1230 - DNA, 20 bp, Artificial Sequence
  Synthetic oligonucleotide
gcttttctggcttcctcttc

SEQ ID NO: 1231 - DNA, 24 bp, Artificial Sequence
  Synthetic oligonucleotide
caactgcatggctctgaacagcct

SEQ ID NO: 1232 - DNA, 76 bp, Artificial Sequence
  Synthetic oligonucleotide
ctgcctatgccagactcagaggaatcgaacaggctgttcagagccatgcagttgctgaagaggaagccagaaaagc

SEQ ID NO: 1233 - DNA, 20 bp, Artificial Sequence
  Synthetic oligonucleotide
cctacagcaagtgcaaggaa

SEQ ID NO: 1234 - DNA, 20 bp, Artificial Sequence
  Synthetic oligonucleotide
catctcgtaggtctgcatgg

SEQ ID NO: 1235 - DNA, 24 bp, Artificial Sequence
  Synthetic oligonucleotide
ccagctgcactttgtcgtcactgt

SEQ ID NO: 1236 - DNA, 65 bp, Artificial Sequence
  Synthetic oligonucleotide
cctacagcaagtgcaaggaatacagtgacgacaaagtgcagctggccatgcagacctacgagatg

SEQ ID NO: 1237 - DNA, 19 bp, Artificial Sequence
  Synthetic oligonucleotide
gtgcccgagccatatagca

SEQ ID NO: 1238 - DNA, 23 bp, Artificial Sequence
  Synthetic oligonucleotide
cggtagtggttgatgactgttga

SEQ ID NO: 1239 - DNA, 25 bp, Artificial Sequence
  Synthetic oligonucleotide
acgtccgggtcctcactgtccttcc

SEQ ID NO: 1240 - DNA, 72 bp, Artificial Sequence
  Synthetic oligonucleotide
gtgcccgagccatatagcaggcacgtccgggtcctcactgtccttccactcaacagtcatcaaccactaccg

SEQ ID NO: 1241 - DNA, 19 bp, Artificial Sequence
  Synthetic oligonucleotide
ctgtcatattgccccatgc

SEQ ID NO: 1242 - DNA, 18 bp, Artificial Sequence
  Synthetic oligonucleotide
cagattccagcagccacc

SEQ ID NO: 1243 - DNA, 24 bp, Artificial Sequence
  Synthetic oligonucleotide
tgagaagacattcaccaccacccc

SEQ ID NO: 1244 - DNA, 67 bp, Artificial Sequence
  Synthetic oligonucleotide
ctgtcatattgccccatgcctgagaagacattcaccaccaccccaggagggtggctgctggaatctg

SEQ ID NO: 1245 - DNA, 22 bp, Artificial Sequence
  Synthetic oligonucleotide
gcttcttctggagatgtgctct

SEQ ID NO: 1246 - DNA, 22 bp, Artificial Sequence
  Synthetic oligonucleotide
cctgtagataatgacctggcct

SEQ ID NO: 1247 - DNA, 24 bp, Artificial Sequence
  Synthetic oligonucleotide
ttgctggacagcctcggtacaatc

SEQ ID NO: 1248 - DNA, 75 bp, Artificial Sequence
  Synthetic oligonucleotide
gcttcttctggagatgtgctctatattgctggacagcctcggtacaatcatacaggccaggtcattatctacagg

SEQ ID NO: 1249 - DNA, 20 bp, Artificial Sequence
  Synthetic oligonucleotide
ccatgatcctcactctgctg

SEQ ID NO: 1250 - DNA, 20 bp, Artificial Sequence
  Synthetic oligonucleotide
gaagctttgtagccggtgat

SEQ ID NO: 1251 - DNA, 24 bp, Artificial Sequence
  Synthetic oligonucleotide
cactccagacctcgcttagcatgg

SEQ ID NO: 1252 - DNA, 77 bp, Artificial Sequence
  Synthetic oligonucleotide
ccatgatcctcactctgctggtggactatacactccagacctcgcttagcatggtaaatcaccggctacaaagcttc

SEQ ID NO: 1253 - DNA, 21 bp, Artificial Sequence
  Synthetic oligonucleotide
caacgcttcagtgatcaatcc

SEQ ID NO: 1254 - DNA, 18 bp, Artificial Sequence
  Synthetic oligonucleotide
gtctggccgggattcttt

SEQ ID NO: 1255 - DNA, 24 bp, Artificial Sequence
  Synthetic oligonucleotide
cgatcctgcatctgtaaatcgccc

SEQ ID NO: 1256 - DNA, 66 bp, Artificial Sequence
  Synthetic oligonucleotide
caacgcttcagtgatcaatcccggggcgatttacagatgcaggatcggaaagaatcccggccagac

SEQ ID NO: 1257 - DNA, 20 bp, Artificial Sequence
  Synthetic oligonucleotide
aggccagccctacattatca

SEQ ID NO: 1258 - DNA, 20 bp, Artificial Sequence
  Synthetic oligonucleotide
gtcttctccacagtccagca

SEQ ID NO: 1259 - DNA, 24 bp, Artificial Sequence
  Synthetic oligonucleotide
tctgagccttgtcctctatccggc

SEQ ID NO: 1260 - DNA, 75 bp, Artificial Sequence
  Synthetic oligonucleotide
aggccagccctacattatcagagcaagagccggatagaggacaaggctcagatcttgctggactgtggagaagac

SEQ ID NO: 1261 - DNA, 20 bp, Artificial Sequence
  Synthetic oligonucleotide
cagtgacaaacagcccttcc

SEQ ID NO: 1262 - DNA, 19 bp, Artificial Sequence
  Synthetic oligonucleotide
gtttagcctcatgggcgtc

SEQ ID NO: 1263 - DNA, 24 bp, Artificial Sequence
  Synthetic oligonucleotide
tcgccatcttttgtgggattcctt

SEQ ID NO: 1264 - DNA, 69 bp, Artificial Sequence
  Synthetic oligonucleotide
cagtgacaaacagcccttccaacccaaggaatcccacaaaagatggcgatgacgcccatgaggctaaac

SEQ ID NO: 1265 - DNA, 22 bp, Artificial Sequence
  Synthetic oligonucleotide
gatatgattggtcgctgctttg

SEQ ID NO: 1266 - DNA, 21 bp, Artificial Sequence
  Synthetic oligonucleotide
agaacttccattccccaccat

SEQ ID NO: 1267 - DNA, 21 bp, Artificial Sequence
  Synthetic oligonucleotide
cagccaggacctggccatccg

SEQ ID NO: 1268 - DNA, 79 bp, Artificial Sequence
  Synthetic oligonucleotide
gatatgattggtcgctgctttgtgctcagccaggacctggccatccgggatgagttggatggtggggaatggaagttct

SEQ ID NO: 1269 - DNA, 18 bp, Artificial Sequence
  Synthetic oligonucleotide
gagcctggtggatcccat

SEQ ID NO: 1270 - DNA, 18 bp, Artificial Sequence
  Synthetic oligonucleotide
actgtcaggatgcccgtg

SEQ ID NO: 1271 - DNA, 24 bp, Artificial Sequence
  Synthetic oligonucleotide
caactgaaaggcctgacgttcacg

SEQ ID NO: 1272 - DNA, 66 bp, Artificial Sequence
  Synthetic oligonucleotide
gagcctggtggatcccatcgtccaactgaaaggcctgacgttcacggccacgggcatcctgacagt

SEQ ID NO: 1273 - DNA, 19 bp, Artificial Sequence
  Synthetic oligonucleotide
accgggagccctacatgac

SEQ ID NO: 1274 - DNA, 27 bp, Artificial Sequence
  Synthetic oligonucleotide
ccttaagctctttcactgactcaatct

SEQ ID NO: 1275 - DNA, 28 bp, Artificial Sequence
  Synthetic oligonucleotide
aaatacctgcaaccgttactgccgtgac

SEQ ID NO: 1276 - DNA, 78 bp, Artificial Sequence
  Synthetic oligonucleotide
accggggagccctacatgacgaaaatacctgcaaccgttactgccgtgacgagattgagtcagtgaaagagcttaagg

SEQ ID NO: 1277 - DNA, 18 bp, Artificial Sequence
  Synthetic oligonucleotide
caaggtgccctcagtgga

SEQ ID NO: 1278 - DNA, 19 bp, Artificial Sequence
  Synthetic oligonucleotide
gcgcacaccttcatctcat

SEQ ID NO: 1279 - DNA, 24 bp, Artificial Sequence
  Synthetic oligonucleotide
caccaacctgtacccgtattgcga

SEQ ID NO: 1280 - DNA, 66 bp, Artificial Sequence
  Synthetic oligonucleotide
caaggtgccctcagtggagctcaccaacctgtacccgtattgcgactatgagatgaaggtgtgcgc

SEQ ID NO: 1281 - DNA, 20 bp, Artificial Sequence
  Synthetic oligonucleotide
tcgtgaaagatgaccaggag

SEQ ID NO: 1282 - DNA, 20 bp, Artificial Sequence
  Synthetic oligonucleotide
ggtgaacatcatgacgcagt

SEQ ID NO: 1283 - DNA, 27 bp, Artificial Sequence
  Synthetic oligonucleotide
tgctatgtttctacaaaaccgccaagg

SEQ ID NO: 1284 - DNA, 71 bp, Artificial Sequence
  Synthetic oligonucleotide
tcgtgaaagatgaccaggaggctgtgctatgtttctacaaaaccgccaaggactgcgtcatgatgttcacc

SEQ ID NO: 1285 - DNA, 19 bp, Artificial Sequence
  Synthetic oligonucleotide
gaggaggtgtgggtgttcc

SEQ ID NO: 1286 - DNA, 18 bp, Artificial Sequence
  Synthetic oligonucleotide
gtaatcccatgtccgcga

SEQ ID NO: 1287 - DNA, 24 bp, Artificial Sequence
  Synthetic oligonucleotide
ccatcctaacggaacgagctccct

SEQ ID NO: 1288 - DNA, 67 bp, Artificial Sequence
  Synthetic oligonucleotide
gaggaggtgtgggtgttccgcttccatcctaacggaacgagctccctcttcgcggacatgggattac

SEQ ID NO: 1289 - DNA, 18 bp, Artificial Sequence
  Synthetic oligonucleotide
ttgccatcgtgtcagtgc

SEQ ID NO: 1290 - DNA, 18 bp, Artificial Sequence
  Synthetic oligonucleotide
atggagctggcgtcattg

SEQ ID NO: 1291 - DNA, 24 bp, Artificial Sequence
  Synthetic oligonucleotide
tccaggtctcggatctcagacacg

SEQ ID NO: 1292 - DNA, 67 bp, Artificial Sequence
  Synthetic oligonucleotide
ttgccatcgtgtcagtgcccgtgtctgagatccgagacctggactttgccaatgacgccagctccat

SEQ ID NO: 1293 - DNA, 18 bp, Artificial Sequence
  Synthetic oligonucleotide
taactgggatgcatgggc

SEQ ID NO: 1294 - DNA, 18 bp, Artificial Sequence
  Synthetic oligonucleotide
ctctgccttaactggccg

SEQ ID NO: 1295 - DNA, 24 bp, Artificial Sequence
  Synthetic oligonucleotide
agccctctctcaccgttccaagtg

SEQ ID NO: 1296 - DNA, 66 bp, Artificial Sequence
  Synthetic oligonucleotide
taactgggatgcatgggcagcccagccctctctcaccgttccaagtgccggccagttaaggcagag

SEQ ID NO: 1297 - DNA, 19 bp, Artificial Sequence
  Synthetic oligonucleotide
tggcttacactggcaatgg

SEQ ID NO: 1298 - DNA, 19 bp, Artificial Sequence
  Synthetic oligonucleotide
gcatagctgtgagatgcgg

SEQ ID NO: 1299 - DNA, 24 bp, Artificial Sequence
  Synthetic oligonucleotide
actcgatttcccagccaaccacag

SEQ ID NO: 1300 - DNA, 69 bp, Artificial Sequence
  Synthetic oligonucleotide
tggcttacactggcaatggtagtttctgtggttggctgggaaatcgagtgccgcatctcacagctatgc

SEQ ID NO: 1301 - DNA, 20 bp, Artificial Sequence
  Synthetic oligonucleotide
gactgcaaagatggaaacga

SEQ ID NO: 1302 - DNA, 20 bp, Artificial Sequence
  Synthetic oligonucleotide
tagccataaggtccgctctc

SEQ ID NO: 1303 - DNA, 24 bp, Artificial Sequence
  Synthetic oligonucleotide
ctatgacgatgccctcaacgcctc

SEQ ID NO: 1304 - DNA, 81 bp, Artificial Sequence
  Synthetic oligonucleotide
gactgcaaagatggaaacgaccttctatgacgatgccctcaacgcctcgttcctcccgtccgagagcggaccttatggcta

SEQ ID NO: 1305 - DNA, 18 bp, Artificial Sequence
  Synthetic oligonucleotide
ctgtcagctgctgcttgg

SEQ ID NO: 1306 - DNA, 18 bp, Artificial Sequence
  Synthetic oligonucleotide
agggggtgtccgtaaagg

SEQ ID NO: 1307 - DNA, 23 bp, Artificial Sequence
  Synthetic oligonucleotide
caagggacacgccttctgaacgt

SEQ ID NO: 1308 - DNA, 70 bp, Artificial Sequence
  Synthetic oligonucleotide
ctgtcagctgctgcttggggtcaagggacacgccttctgaacgtcccctgcccctttacggacaccccct

SEQ ID NO: 1309 - DNA, 22 bp, Artificial Sequence
  Synthetic oligonucleotide
tgtgctattcatcccatacctg

SEQ ID NO: 1310 - DNA, 19 bp, Artificial Sequence
  Synthetic oligonucleotide
gggcataggagaaggcaag

SEQ ID NO: 1311 - DNA, 24 bp, Artificial Sequence
  Synthetic oligonucleotide
ttatacattcacatggacggcccg

SEQ ID NO: 1312 - DNA, 70 bp, Artificial Sequence
  Synthetic oligonucleotide
tgtgctattcatcccatacctgggaattatacattcacatggacggcccggcttgccttctcctatgccc

SEQ ID NO: 1313 - DNA, 20 bp, Artificial Sequence
  Synthetic oligonucleotide
agcagttactggcaagaggg

SEQ ID NO: 1314 - DNA, 18 bp, Artificial Sequence
  Synthetic oligonucleotide
tggagacctgagcagcct

SEQ ID NO: 1315 - DNA, 24 bp, Artificial Sequence
  Synthetic oligonucleotide
actcttaggcggcagcgtcctttc

SEQ ID NO: 1316 - DNA, 66 bp, Artificial Sequence
  Synthetic oligonucleotide
agcagttactggcaagagggagaaaggacgctgccgcctaagagtgcaaggctgctcaggtctcca

SEQ ID NO: 1317 - DNA, 18 bp, Artificial Sequence
  Synthetic oligonucleotide
cgggcaagaagagtggac

SEQ ID NO: 1318 - DNA, 20 bp, Artificial Sequence
  Synthetic oligonucleotide
ctgtagacgccctttgctgt

SEQ ID NO: 1319 - DNA, 24 bp, Artificial Sequence
  Synthetic oligonucleotide
caagacacaaggcaccttcagcga

SEQ ID NO: 1320 - DNA, 69 bp, Artificial Sequence
  Synthetic oligonucleotide
cgggcaagaagagtggactaactcaagacacaaggcaccttcagcgaggacagcaaagggcgtctacag

SEQ ID NO: 1321 - DNA, 19 bp, Artificial Sequence
  Synthetic oligonucleotide
cagacaccagctctgaggc

SEQ ID NO: 1322 - DNA, 18 bp, Artificial Sequence
  Synthetic oligonucleotide
aacattgtgaggcggacc

SEQ ID NO: 1323 - DNA, 24 bp, Artificial Sequence
  Synthetic oligonucleotide
tccccagtgtccaggcacagagta

SEQ ID NO: 1324 - DNA, 74 bp, Artificial Sequence
  Synthetic oligonucleotide
cagacaccagctctgaggccagttaatcatccccagtgtccaggcacagagtagtcggtccgcctcacaatgtt

SEQ ID NO: 1325 - DNA, 18 bp, Artificial Sequence
  Synthetic oligonucleotide
ccgtgggacatggagtgt

SEQ ID NO: 1326 - DNA, 20 bp, Artificial Sequence
  Synthetic oligonucleotide
gaagcaagtccgtctccaag

SEQ ID NO: 1327 - DNA, 24 bp, Artificial Sequence
  Synthetic oligonucleotide
tccgctagtgatcctttgcaccct

SEQ ID NO: 1328 - DNA, 67 bp, Artificial Sequence
  Synthetic oligonucleotide
ccgtgggacatggagtgttccttccgctagtgatcctttgcaccctgcttggagacggacttgcttc

SEQ ID NO: 1329 - DNA, 20 bp, Artificial Sequence
  Synthetic oligonucleotide
agagctggtctcctccaaaa

SEQ ID NO: 1330 - DNA, 20 bp, Artificial Sequence
  Synthetic oligonucleotide
gctggtcttgctctgtttca

SEQ ID NO: 1331 - DNA, 25 bp, Artificial Sequence
  Synthetic oligonucleotide
caggtcagcaaacttgaaagcagcc

SEQ ID NO: 1332 - DNA, 67 bp, Artificial Sequence
  Synthetic oligonucleotide
agagctggtctcctccaaaatacaggtcagcaaacttgaaagcagcctgaaacagagcaagaccagc

SEQ ID NO: 1333 - DNA, 25 bp, Artificial Sequence
  Synthetic oligonucleotide
gaggcaactgcttatggcttaatta

SEQ ID NO: 1334 - DNA, 18 bp, Artificial Sequence
  Synthetic oligonucleotide
ggcactcggcttgagcat

SEQ ID NO: 1335 - DNA, 24 bp, Artificial Sequence
  Synthetic oligonucleotide
ttacagcgacagtcatggccgcat

SEQ ID NO: 1336 - DNA, 75 bp, Artificial Sequence
  Synthetic oligonucleotide
gaggcaactgcttatggcttaattaagtcagatgcggccatgactgtcgctgtaaagatgctcaagccgagtgcc

SEQ ID NO: 1337 - DNA, 20 bp, Artificial Sequence
  Synthetic oligonucleotide
agtggctacgggatgaactg

SEQ ID NO: 1338 - DNA, 20 bp, Artificial Sequence
  Synthetic oligonucleotide
tgagccacagactgctcact

SEQ ID NO: 1339 - DNA, 24 bp, Artificial Sequence
  Synthetic oligonucleotide
caacacgcagcagaaactgcagaa

SEQ ID NO: 1340 - DNA, 67 bp, Artificial Sequence
  Synthetic oligonucleotide
agtggctacgggatgaactggccaacacgcagcagaaactgcagaagagtgagcagtctgtggctca

SEQ ID NO: 1341 - DNA, 20 bp, Artificial Sequence
  Synthetic oligonucleotide
cacgagaccggctacttctc

SEQ ID NO: 1342 - DNA, 20 bp, Artificial Sequence
  Synthetic oligonucleotide
gctctaggcaggtctgttgc

SEQ ID NO: 1343 - DNA, 24 bp, Artificial Sequence
  Synthetic oligonucleotide
agtactcctccagagacggcagcg

SEQ ID NO: 1344 - DNA, 67 bp, Artificial Sequence
  Synthetic oligonucleotide
cacgagaccggctacttctcggcgctgccgtctctggaggagtactggcaacagacctgcctagagc

SEQ ID NO: 1345 - DNA, 20 bp, Artificial Sequence
  Synthetic oligonucleotide
aacacagcccagtttgttca

SEQ ID NO: 1346 - DNA, 20 bp, Artificial Sequence
  Synthetic oligonucleotide
ccaggaggctcatgttgaag

SEQ ID NO: 1347 - DNA, 24 bp, Artificial Sequence
  Synthetic oligonucleotide
tcagtgagagcttcccacaccctg

SEQ ID NO: 1348 - DNA, 67 bp, Artificial Sequence
  Synthetic oligonucleotide
aacacagcccagtttgttcatgtcagtgagagcttcccacaccctggcttcaacatgagcctcctgg

SEQ ID NO: 1349 - DNA, 18 bp, Artificial Sequence
  Synthetic oligonucleotide
gcccagaggctccatcgt

SEQ ID NO: 1350 - DNA, 23 bp, Artificial Sequence
  Synthetic oligonucleotide
cagaggtttgaacagtgcagaca

SEQ ID NO: 1351 - DNA, 23 bp, Artificial Sequence
  Synthetic oligonucleotide
cctcttcctccccagtcggctga

SEQ ID NO: 1352 - DNA, 78 bp, Artificial Sequence
  Synthetic oligonucleotide
gcccagaggctccatcgtccatcctcttcctccccagtcggctgaactctccccttgtctgcactgttcaaacctctg

SEQ ID NO: 1353 - DNA, 18 bp, Artificial Sequence
  Synthetic oligonucleotide
caccccggcttcaacaac

SEQ ID NO: 1354 - DNA, 22 bp, Artificial Sequence
  Synthetic oligonucleotide
catcttcaccagcatgatgtca

SEQ ID NO: 1355 - DNA, 23 bp, Artificial Sequence
  Synthetic oligonucleotide
cctccccaacaaagaccaccgca

SEQ ID NO: 1356 - DNA, 66 bp, Artificial Sequence
  Synthetic oligonucleotide
caccccggcttcaacaacagcctccccaacaaagaccaccgcaatgacatcatgctggtgaagatg

SEQ ID NO: 1357 - DNA, 20 bp, Artificial Sequence
  Synthetic oligonucleotide
cccctaaaatgttcctcctg

SEQ ID NO: 1358 - DNA, 20 bp, Artificial Sequence
  Synthetic oligonucleotide
ctcatcctcttggctctgtg

SEQ ID NO: 1359 - DNA, 27 bp, Artificial Sequence
  Synthetic oligonucleotide
cagcacttcaagtcctggctatagcca

SEQ ID NO: 1360 - DNA, 74 bp, Artificial Sequence
  Synthetic oligonucleotide
cccctaaaatgttcctcctgctgacagcacttcaagtcctggctatagccatgacacagagccaagaggatgag

SEQ ID NO: 1361 - DNA, 19 bp, Artificial Sequence
  Synthetic oligonucleotide
agtctcggattgtgggagg

SEQ ID NO: 1362 - DNA, 18 bp, Artificial Sequence
  Synthetic oligonucleotide
tgtacacagccacctgcc

SEQ ID NO: 1363 - DNA, 24 bp, Artificial Sequence
  Synthetic oligonucleotide
ttgggaatgcttctcacactccca

SEQ ID NO: 1364 - DNA, 66 bp, Artificial Sequence
  Synthetic oligonucleotide
agtctcggattgtgggaggctgggagtgtgagaagcattcccaaccctggcaggtggctgtgtaca

SEQ ID NO: 1365 - DNA, 19 bp, Artificial Sequence
  Synthetic oligonucleotide
ccaagcttaccacctgcac

SEQ ID NO: 1366 - DNA, 19 bp, Artificial Sequence
  Synthetic oligonucleotide
agggtgaggaagacaaccg

SEQ ID NO: 1367 - DNA, 24 bp, Artificial Sequence
  Synthetic oligonucleotide
acccacatggtgacacagctctcc

SEQ ID NO: 1368 - DNA, 66 bp, Artificial Sequence
  Synthetic oligonucleotide
ccaagcttaccacctgcacccggagagctgtgtcaccatgtgggtcccggttgtcttcctcaccct

SEQ ID NO: 1369 - DNA, 20 bp, Artificial Sequence
  Synthetic oligonucleotide
tgagagccaggcttcttgta

SEQ ID NO: 1370 - DNA, 20 bp, Artificial Sequence
  Synthetic oligonucleotide
atcctggtcctctttgctgt

SEQ ID NO: 1371 - DNA, 25 bp, Artificial Sequence
  Synthetic oligonucleotide
tgtctcaaaatgccagccttctgaa

SEQ ID NO: 1372 - DNA, 70 bp, Artificial Sequence
  Synthetic oligonucleotide
tgagagccaggcttcttgtatgtctcaaaatgccagccttctgaaagtatacagcaaagaggaccaggat

SEQ ID NO: 1373 - DNA, 20 bp, Artificial Sequence
  Synthetic oligonucleotide
tgatggtccaaatgaacgaa

SEQ ID NO: 1374 - DNA, 19 bp, Artificial Sequence
  Synthetic oligonucleotide
aagcttcacaagttggggc

SEQ ID NO: 1375 - DNA, 24 bp, Artificial Sequence
  Synthetic oligonucleotide
actcctgttttcaccaccatgcca

SEQ ID NO: 1376 - DNA, 67 bp, Artificial Sequence
  Synthetic oligonucleotide
tgatggtccaaatgaacgaattggcatggtggtgaaaacaggagttgtgccccaacttgtgaagctt

SEQ ID NO: 1377 - DNA, 18 bp, Artificial Sequence
  Synthetic oligonucleotide
tggacaacaaccgcagtc

SEQ ID NO: 1378 - DNA, 20 bp, Artificial Sequence
  Synthetic oligonucleotide
tatcctcgtactgggccttg

SEQ ID NO: 1379 - DNA, 24 bp, Artificial Sequence
  Synthetic oligonucleotide
cctcagcaatgatgctgtccaggt

SEQ ID NO: 1380 - DNA, 66 bp, Artificial Sequence
  Synthetic oligonucleotide
tggacaacaaccgcagtctcgacctggacagcatcattgctgaggtcaaggcccagtacgaggata

SEQ ID NO: 1381 - DNA, 20 bp, Artificial Sequence
  Synthetic oligonucleotide
gcctggttcttcagcaagac

SEQ ID NO: 1382 - DNA, 21 bp, Artificial Sequence
  Synthetic oligonucleotide
cttgctggtctggatcatttc

SEQ ID NO: 1383 - DNA, 24 bp, Artificial Sequence
  Synthetic oligonucleotide
tgaacaaagaggtggcctccaaca

SEQ ID NO: 1384 - DNA, 75 bp, Artificial Sequence
  Synthetic oligonucleotide
gcctggttcttcagcaagactgaggagctgaacaaagaggtggcctccaacacagaaatgatccagaccagcaag

SEQ ID NO: 1385 - DNA, 20 bp, Artificial Sequence
  Synthetic oligonucleotide
agagatcgaggctctcaagg

SEQ ID NO: 1386 - DNA, 20 bp, Artificial Sequence
  Synthetic oligonucleotide
ggccttttacttcctcttcg

SEQ ID NO: 1387 - DNA, 27 bp, Artificial Sequence
  Synthetic oligonucleotide
tggttcttcttcatgaagagcagctcc

SEQ ID NO: 1388 - DNA, 68 bp, Artificial Sequence
  Synthetic oligonucleotide
agagatcgaggctctcaaggaggagctgctcttcatgaagaagaaccacgaagaggaagtaaaaggcc

SEQ ID NO: 1389 - DNA, 19 bp, Artificial Sequence
  Synthetic oligonucleotide
ccagtgacgcctctgtgtt

SEQ ID NO: 1390 - DNA, 18 bp, Artificial Sequence
  Synthetic oligonucleotide
gggcatggctagaagcac

SEQ ID NO: 1391 - DNA, 24 bp, Artificial Sequence
  Synthetic oligonucleotide
acctagacagcacagattccgccc

SEQ ID NO: 1392 - DNA, 66 bp, Artificial Sequence
  Synthetic oligonucleotide
ccagtgacgcctctgtgttctggggcggaatctgtgctgtctaggtttgtgcttctagccatgccc

SEQ ID NO: 1393 - DNA, 20 bp, Artificial Sequence
  Synthetic oligonucleotide
tcagtggagaaggagttgga

SEQ ID NO: 1394 - DNA, 20 bp, Artificial Sequence
  Synthetic oligonucleotide
tgccatatccagaggaaaca

SEQ ID NO: 1395 - DNA, 28 bp, Artificial Sequence
  Synthetic oligonucleotide
ccagtcaacatctctgttgtcacaagca

SEQ ID NO: 1396 - DNA, 69 bp, Artificial Sequence
  Synthetic oligonucleotide
tcagtggagaaggagttggaccagtcaacatctctgttgtcacaagcagtgtttcctctggatatggca

SEQ ID NO: 1397 - DNA, 26 bp, Artificial Sequence
  Synthetic oligonucleotide
tcaaagtcaggtacgaagatgaaatt

SEQ ID NO: 1398 - DNA, 22 bp, Artificial Sequence
  Synthetic oligonucleotide
acgtcctttttcagggctacaa

SEQ ID NO: 1399 - DNA, 26 bp, Artificial Sequence
  Synthetic oligonucleotide
ttcattctcagcagctgtgcgcttgt

SEQ ID NO: 1400 - DNA, 76 bp, Artificial Sequence
  Synthetic oligonucleotide
tcaaagtcaggtacgaagatgaaattaacaagcgcacagctgctgagaatgaatttgtagccctgaaaaaggacgt

SEQ ID NO: 1401 - DNA, 20 bp, Artificial Sequence
  Synthetic oligonucleotide
atctccagactgctggttcc

SEQ ID NO: 1402 - DNA, 20 bp, Artificial Sequence
  Synthetic oligonucleotide
tcagggaattaggggacaga

SEQ ID NO: 1403 - DNA, 24 bp, Artificial Sequence
  Synthetic oligonucleotide
tctgggcttcagatcctgactccc

SEQ ID NO: 1404 - DNA, 83 bp, Artificial Sequence
  Synthetic oligonucleotide
atctccagactgctggttcccagggaaccctccctacatctgggcttcagatcctgactcccttctgtcccctaattccctga

SEQ ID NO: 1405 - DNA, 27 bp, Artificial Sequence
  Synthetic oligonucleotide
ggatgaagcttacatgaacaaggtaga

SEQ ID NO: 1406 - DNA, 25 bp, Artificial Sequence
  Synthetic oligonucleotide
catatagctgcctgaggaagttgat

SEQ ID NO: 1407 - DNA, 21 bp, Artificial Sequence
  Synthetic oligonucleotide
cgtcggtcagcccttccaggc

SEQ ID NO: 1408 - DNA, 86 bp, Artificial Sequence
  Synthetic oligonucleotide
ggatgaagcttacatgaacaaggtagagctggagtctcgcctggaagggctgaccgacgagatcaacttcctcaggcagctatatg

SEQ ID NO: 1409 - DNA, 18 bp, Artificial Sequence
  Synthetic oligonucleotide
cttgctggccaatgccta

SEQ ID NO: 1410 - DNA, 18 bp, Artificial Sequence
  Synthetic oligonucleotide
tgattgtccgcagtcagg

SEQ ID NO: 1411 - DNA, 24 bp, Artificial Sequence
  Synthetic oligonucleotide
atctacgttgtccagctgccagcc

SEQ ID NO: 1412 - DNA, 66 bp, Artificial Sequence
  Synthetic oligonucleotide
cttgctggccaatgcctacatctacgttgtccagctgccagccaagatcctgactgcggacaatca

SEQ ID NO: 1413 - DNA, 20 bp, Artificial Sequence
  Synthetic oligonucleotide
gccttagagcaagggattca

SEQ ID NO: 1414 - DNA, 18 bp, Artificial Sequence
  Synthetic oligonucleotide
cggttcttgctccagctc

SEQ ID NO: 1415 - DNA, 24 bp, Artificial Sequence
  Synthetic oligonucleotide
tctatcttgctctgagcctgcgga

SEQ ID NO: 1416 - DNA, 66 bp, Artificial Sequence
  Synthetic oligonucleotide
gccttagagcaagggattcaccctccgcaggctcagagcaagatagaggagctggagcaagaaccg

SEQ ID NO: 1417 - DNA, 19 bp, Artificial Sequence
  Synthetic oligonucleotide
cctgtcactgaagccttgg

SEQ ID NO: 1418 - DNA, 21 bp, Artificial Sequence
  Synthetic oligonucleotide
tgggttactggtcaggacaac

SEQ ID NO: 1419 - DNA, 24 bp, Artificial Sequence
  Synthetic oligonucleotide
attcagactgacaggcccctggac

SEQ ID NO: 1420 - DNA, 67 bp, Artificial Sequence
  Synthetic oligonucleotide
cctgtcactgaagccttggaagtccaggggcctgtcagtctgaatggttgtcctgaccagtaaccca

SEQ ID NO: 1421 - DNA, 19 bp, Artificial Sequence
  Synthetic oligonucleotide
gatgcactgcggttagcag

SEQ ID NO: 1422 - DNA, 20 bp, Artificial Sequence
  Synthetic oligonucleotide
cagaggatacgctcagcacc

SEQ ID NO: 1423 - DNA, 24 bp, Artificial Sequence
  Synthetic oligonucleotide
ctctccatcgaggaaggcaaatcc

SEQ ID NO: 1424 - DNA, 67 bp, Artificial Sequence
  Synthetic oligonucleotide
gatgcactgcggttagcagcgctctccatcgaggaaggcaaatccggggtgctgagcgtatcctctg

SEQ ID NO: 1425 - DNA, 18 bp, Artificial Sequence
  Synthetic oligonucleotide
ctcctggccaacagcact

SEQ ID NO: 1426 - DNA, 18 bp, Artificial Sequence
  Synthetic oligonucleotide
acacaaggcccagcctct

SEQ ID NO: 1427 - DNA, 24 bp, Artificial Sequence
  Synthetic oligonucleotide
ctgttcctggagcatggcctcttc

SEQ ID NO: 1428 - DNA, 67 bp, Artificial Sequence
  Synthetic oligonucleotide
ctcctggccaacagcactgcactagaagaggccatgctccaggaacagcagaggctgggccttgtgt

SEQ ID NO: 1429 - DNA, 20 bp, Artificial Sequence
  Synthetic oligonucleotide
caaggagactgggaggtgtc

SEQ ID NO: 1430 - DNA, 20 bp, Artificial Sequence
  Synthetic oligonucleotide
cggcagaactgacagtgttc

SEQ ID NO: 1431 - DNA, 24 bp, Artificial Sequence
  Synthetic oligonucleotide
caagtgcctgtaccacacggaagg

SEQ ID NO: 1432 - DNA, 66 bp, Artificial Sequence
  Synthetic oligonucleotide
caaggagactgggaggtgtctcaagtgcctgtaccacacggaaggggaacactgtcagttctgccg

SEQ ID NO: 1433 - DNA, 20 bp, Artificial Sequence
  Synthetic oligonucleotide
actgaccaagcctgagacct

SEQ ID NO: 1434 - DNA, 20 bp, Artificial Sequence
  Synthetic oligonucleotide
gtcacacttgcagcatttca

SEQ ID NO: 1435 - DNA, 23 bp, Artificial Sequence
  Synthetic oligonucleotide
ccactcgccatactgggtgcagt

SEQ ID NO: 1436 - DNA, 67 bp, Artificial Sequence
  Synthetic oligonucleotide
actgaccaagcctgagacctactgcacccagtatggcgagtggcagatgaaatgctgcaagtgtgac

SEQ ID NO: 1437 - DNA, 21 bp, Artificial Sequence
  Synthetic oligonucleotide
gccgtgatctcagacagctac

SEQ ID NO: 1438 - DNA, 19 bp, Artificial Sequence
  Synthetic oligonucleotide
acctgcttgcccaagaact

SEQ ID NO: 1439 - DNA, 24 bp, Artificial Sequence
  Synthetic oligonucleotide
cctcggtacttcattgctcctgca

SEQ ID NO: 1440 - DNA, 68 bp, Artificial Sequence
  Synthetic oligonucleotide
gccgtgatctcagacagctactttcctcggtacttcattgctcctgcaaagttcttgggcaagcaggt

SEQ ID NO: 1441 - DNA, 21 bp, Artificial Sequence
  Synthetic oligonucleotide
actcaagcggaaattgaagca

SEQ ID NO: 1442 - DNA, 21 bp, Artificial Sequence
  Synthetic oligonucleotide
actccctgaagccgagacact

SEQ ID NO: 1443 - DNA, 28 bp, Artificial Sequence
  Synthetic oligonucleotide
aggtcttatcagcacagtctccgcctcc

SEQ ID NO: 1444 - DNA, 80 bp, Artificial Sequence
  Synthetic oligonucleotide
actcaagcggaaattgaagcagataggtcttatcagcacagtctccgcctcctggattcagtgtctcggcttcagggagt

SEQ ID NO: 1445 - DNA, 19 bp, Artificial Sequence
  Synthetic oligonucleotide
tgctggacttctgcctgag

SEQ ID NO: 1446 - DNA, 20 bp, Artificial Sequence
  Synthetic oligonucleotide
tgagataggtgggcacttcc

SEQ ID NO: 1447 - DNA, 24 bp, Artificial Sequence
  Synthetic oligonucleotide
tcctgaccctctgcagctcctaca

SEQ ID NO: 1448 - DNA, 66 bp, Artificial Sequence
  Synthetic oligonucleotide
tgctggacttctgcctgagcatcctgaccctctgcagctcctacatggaagtgcccacctatctca

SEQ ID NO: 1449 - DNA, 20 bp, Artificial Sequence
  Synthetic oligonucleotide
agcggaaaatggcagacaat

SEQ ID NO: 1450 - DNA, 20 bp, Artificial Sequence
  Synthetic oligonucleotide
cttgagggtttgggtttcca

SEQ ID NO: 1451 - DNA, 25 bp, Artificial Sequence
  Synthetic oligonucleotide
acccagataacgcatcatggagcga

SEQ ID NO: 1452 - DNA, 69 bp, Artificial Sequence
  Synthetic oligonucleotide
agcggaaaatggcagacaatttttcgctccatgatgcgttatctgggtctggaaacccaaaccctcaag

SEQ ID NO: 1453 - DNA, 18 bp, Artificial Sequence
  Synthetic oligonucleotide
ggaggtggagaaggagcc

SEQ ID NO: 1454 - DNA, 19 bp, Artificial Sequence
  Synthetic oligonucleotide
acaggtgtcatcagcgagg

SEQ ID NO: 1455 - DNA, 24 bp, Artificial Sequence
  Synthetic oligonucleotide
ctggacgctcagagctcgtctctg

SEQ ID NO: 1456 - DNA, 66 bp, Artificial Sequence
  Synthetic oligonucleotide
ggaggtggagaaggagccgggccagagacgagctctgagcgtccaggcctcgctgatgacacctgt

SEQ ID NO: 1457 - DNA, 20 bp, Artificial Sequence
  Synthetic oligonucleotide
tgaacagtaatggggagctg

SEQ ID NO: 1458 - DNA, 19 bp, Artificial Sequence
  Synthetic oligonucleotide
ttctgggaactgctggaag

SEQ ID NO: 1459 - DNA, 24 bp, Artificial Sequence
  Synthetic oligonucleotide
actgagcgcacacgaaacactgct

SEQ ID NO: 1460 - DNA, 71 bp, Artificial Sequence
  Synthetic oligonucleotide
tgaacagtaatggggagctgtaccatgagcagtgtttcgtgtgcgctcagtgcttccagcagttcccagaa

SEQ ID NO: 1461 - DNA, 18 bp, Artificial Sequence
  Synthetic oligonucleotide
ccaatgggagaacaacgg

SEQ ID NO: 1462 - DNA, 19 bp, Artificial Sequence
  Synthetic oligonucleotide
cgctgaggctggtactgtg

SEQ ID NO: 1463 - DNA, 24 bp, Artificial Sequence
  Synthetic oligonucleotide
caggctcagcaagctgaacacctg

SEQ ID NO: 1464 - DNA, 66 bp, Artificial Sequence
  Synthetic oligonucleotide
ccaatgggagaacaacgggcaggtgttcagcttgctgagcctgggctcacagtaccagcctcagcg

SEQ ID NO: 1465 - DNA, 19 bp, Artificial Sequence
  Synthetic oligonucleotide
tttggcccaatgggctaag

SEQ ID NO: 1466 - DNA, 21 bp, Artificial Sequence
  Synthetic oligonucleotide
gtctcgatgcggtcgtagaag

SEQ ID NO: 1467 - DNA, 21 bp, Artificial Sequence
  Synthetic oligonucleotide
tcccggctgggcgcctctact

SEQ ID NO: 1468 - DNA, 79 bp, Artificial Sequence
  Synthetic oligonucleotide
tttggcccaatgggctaagcctggacatcccggctgggcgcctctactgggtggatgccttctacgaccgcatcgagac

SEQ ID NO: 1469 - DNA, 20 bp, Artificial Sequence
  Synthetic oligonucleotide
gcacacccatccttgagtct

SEQ ID NO: 1470 - DNA, 18 bp, Artificial Sequence
  Synthetic oligonucleotide
gatggctggccacgtagt

SEQ ID NO: 1471 - DNA, 24 bp, Artificial Sequence
  Synthetic oligonucleotide
ctttgcagccctcagaactccagc

SEQ ID NO: 1472 - DNA, 66 bp, Artificial Sequence
  Synthetic oligonucleotide
gcacacccatccttgagtctcctttgcagccctcagaactccagccccactacgtggccagccatc

SEQ ID NO: 1473 - DNA, 22 bp, Artificial Sequence
  Synthetic oligonucleotide
ggctcttttgaaggattggtaa

SEQ ID NO: 1474 - DNA, 21 bp, Artificial Sequence
  Synthetic oligonucleotide
aaaagcagctgaaacagcatc

SEQ ID NO: 1475 - DNA, 24 bp, Artificial Sequence
  Synthetic oligonucleotide
cctgaccttcatccatctccagca

SEQ ID NO: 1476 - DNA, 84 bp, Artificial Sequence
  Synthetic oligonucleotide
ggctcttttgaaggattggtaaacctgaccttcatccatctccagcacaatcggctgaaagaggatgctgtttcagctgctttt

SEQ ID NO: 1477 - DNA, 19 bp, Artificial Sequence
  Synthetic oligonucleotide
gcatctaacagccctgtgc

SEQ ID NO: 1478 - DNA, 20 bp, Artificial Sequence
  Synthetic oligonucleotide
cagagtgaagaatgggcctc

SEQ ID NO: 1479 - DNA, 24 bp, Artificial Sequence
  Synthetic oligonucleotide
cagcttcccttgcctcgtgtaaca

SEQ ID NO: 1480 - DNA, 66 bp, Artificial Sequence
  Synthetic oligonucleotide
gcatctaacagccctgtgcagcagcttcccttgcctcgtgtaacatgaggcccattcttcactctg

SEQ ID NO: 1481 - DNA, 19 bp, Artificial Sequence
  Synthetic oligonucleotide
cagatgtgaagcctggagc

SEQ ID NO: 1482 - DNA, 18 bp, Artificial Sequence
  Synthetic oligonucleotide
aagggaatcccctcatgg

SEQ ID NO: 1483 - DNA, 24 bp, Artificial Sequence
  Synthetic oligonucleotide
ttcctgatgatgctggccctacag

SEQ ID NO: 1484 - DNA, 67 bp, Artificial Sequence
  Synthetic oligonucleotide
cagatgtgaagcctggagctttcctgatgatgctggccctacagtacccccatgaggggattccctt

SEQ ID NO: 1485 - DNA, 19 bp, Artificial Sequence
  Synthetic oligonucleotide
gtgtcagccaaagcatgga

SEQ ID NO: 1486 - DNA, 20 bp, Artificial Sequence
  Synthetic oligonucleotide
cgactacgtcgaacatgtgg

SEQ ID NO: 1487 - DNA, 24 bp, Artificial Sequence
  Synthetic oligonucleotide
ccgcgatactcgccttctcttgat

SEQ ID NO: 1488 - DNA, 66 bp, Artificial Sequence
  Synthetic oligonucleotide
gtgtcagccaaagcatggagaatcaagagaaggcgagtatcgcgggccacatgttcgacgtagtcg

SEQ ID NO: 1489 - DNA, 19 bp, Artificial Sequence
  Synthetic oligonucleotide
aggaccaagaggctacgga

SEQ ID NO: 1490 - DNA, 20 bp, Artificial Sequence
  Synthetic oligonucleotide
cctgtggccatttcaatgat

SEQ ID NO: 1491 - DNA, 24 bp, Artificial Sequence
  Synthetic oligonucleotide
cagcccagagaccagatgtctgct

SEQ ID NO: 1492 - DNA, 72 bp, Artificial Sequence
  Synthetic oligonucleotide
aggaccaagaggctacggaaaagcagcagacatctggtctctgggctgtacaatcattgaaatggccacagg

SEQ ID NO: 1493 - DNA, 22 bp, Artificial Sequence
  Synthetic oligonucleotide
caggcaagaactagttgcagaa

SEQ ID NO: 1494 - DNA, 21 bp, Artificial Sequence
  Synthetic oligonucleotide
cctgtaccaggcgagatgtat

SEQ ID NO: 1495 - DNA, 24 bp, Artificial Sequence
  Synthetic oligonucleotide
tgctggtccttttcatcctggtcc

SEQ ID NO: 1496 - DNA, 71 bp, Artificial Sequence
  Synthetic oligonucleotide
caggcaagaactagttgcagaactggaccaggatgaaaaggaccagcaaaatacatctcgcctggtacagg

SEQ ID NO: 1497 - DNA, 18 bp, Artificial Sequence
  Synthetic oligonucleotide
tcgccgagatttcctgag

SEQ ID NO: 1498 - DNA, 20 bp, Artificial Sequence
  Synthetic oligonucleotide
ctgttgtctccgaagagcct

SEQ ID NO: 1499 - DNA, 24 bp, Artificial Sequence
  Synthetic oligonucleotide
aacgttccttgttctcctgctgca

SEQ ID NO: 1500 - DNA, 67 bp, Artificial Sequence
  Synthetic oligonucleotide
tcgccgagatttcctgagactgcagcaggagaacaaggaacgttccgaggctcttcggagacaacag

SEQ ID NO: 1501 - DNA, 21 bp, Artificial Sequence
  Synthetic oligonucleotide
gaggaacagaggtgtctgcac

SEQ ID NO: 1502 - DNA, 18 bp, Artificial Sequence
  Synthetic oligonucleotide
ctgccaactggctttcca

SEQ ID NO: 1503 - DNA, 24 bp, Artificial Sequence
  Synthetic oligonucleotide
catgtacaacaaacgctccgggaa

SEQ ID NO: 1504 - DNA, 67 bp, Artificial Sequence
  Synthetic oligonucleotide
gaggaacagaggtgtctgcacttccatgtacaacaaacgctccgggaaatggaaagccagttggcag

SEQ ID NO: 1505 - DNA, 20 bp, Artificial Sequence
  Synthetic oligonucleotide
aagctgcagagataatgcgg

SEQ ID NO: 1506 - DNA, 19 bp, Artificial Sequence
  Synthetic oligonucleotide
gtgggcaatgttatggctg

SEQ ID NO: 1507 - DNA, 24 bp, Artificial Sequence
  Synthetic oligonucleotide
attggcactgccatccagtttctg

SEQ ID NO: 1508 - DNA, 68 bp, Artificial Sequence
  Synthetic oligonucleotide
aagctgcagagataatgcgggatattggcactgccatccagtttctgcacagccataacattgcccac

SEQ ID NO: 1509 - DNA, 21 bp, Artificial Sequence
  Synthetic oligonucleotide
gacttttgcccgctacctttc

SEQ ID NO: 1510 - DNA, 26 bp, Artificial Sequence
  Synthetic oligonucleotide
gccactaactgcttcagtatgaagag

SEQ ID NO: 1511 - DNA, 24 bp, Artificial Sequence
  Synthetic oligonucleotide
acagctcattgttgtcacgccgga

SEQ ID NO: 1512 - DNA, 75 bp, Artificial Sequence
  Synthetic oligonucleotide
gacttttgcccgctacctttcattccggcgtgacaacaatgagctgttgctcttcatactgaagcagttagtggc

SEQ ID NO: 1513 - DNA, 20 bp, Artificial Sequence
  Synthetic oligonucleotide
ggagaacaatccccttgaga

SEQ ID NO: 1514 - DNA, 20 bp, Artificial Sequence
  Synthetic oligonucleotide
atctcctggatggtgatggt

SEQ ID NO: 1515 - DNA, 27 bp, Artificial Sequence
  Synthetic oligonucleotide
tggcctttctgtctacaaggatcacca

SEQ ID NO: 1516 - DNA, 75 bp, Artificial Sequence
  Synthetic oligonucleotide
ggagaacaatccccttgagacagaatatggcctttctgtctacaaggatcaccagaccatcaccatccaggagat

SEQ ID NO: 1517 - DNA, 24 bp, Artificial Sequence
  Synthetic oligonucleotide
tgatggtcctatgtgtcacattca

SEQ ID NO: 1518 - DNA, 20 bp, Artificial Sequence
  Synthetic oligonucleotide
tgggacaggaaacacaccaa

SEQ ID NO: 1519 - DNA, 30 bp, Artificial Sequence
  Synthetic oligonucleotide
caggtttcataccaacacaggcttcagcac

SEQ ID NO: 1520 - DNA, 82 bp, Artificial Sequence
  Synthetic oligonucleotide
tgatggtcctatgtgtcacattcatcacaggtttcataccaacacaggcttcagcacttcctttggtgtgtttcctgtccca

SEQ ID NO: 1521 - DNA, 19 bp, Artificial Sequence
  Synthetic oligonucleotide
ggagccgactgcaagtaca

SEQ ID NO: 1522 - DNA, 18 bp, Artificial Sequence
  Synthetic oligonucleotide
gactttggtgcctgtgcc

SEQ ID NO: 1523 - DNA, 24 bp, Artificial Sequence
  Synthetic oligonucleotide
atcacacgcaccccagttctcaaa

SEQ ID NO: 1524 - DNA, 66 bp, Artificial Sequence
  Synthetic oligonucleotide
ggagccgactgcaagtacaagtttgagaactggggtgcgtgtgatgggggcacaggcaccaaagtc

SEQ ID NO: 1525 - DNA, 19 bp, Artificial Sequence
  Synthetic oligonucleotide
ctacagggacgccatcgaa

SEQ ID NO: 1526 - DNA, 23 bp, Artificial Sequence
  Synthetic oligonucleotide
atccaaccaatcacctgaatgtt

SEQ ID NO: 1527 - DNA, 23 bp, Artificial Sequence
  Synthetic oligonucleotide
cttacaccagcatcaagatccgg

SEQ ID NO: 1528 - DNA, 68 bp, Artificial Sequence
  Synthetic oligonucleotide
ctacagggacgccatcgaatccggatcttgatgctggtgtaagtgaacattcaggtgattggttggat

SEQ ID NO: 1529 - DNA, 20 bp, Artificial Sequence
  Synthetic oligonucleotide
aggatcgcctgtcagaagag

SEQ ID NO: 1530 - DNA, 20 bp, Artificial Sequence
  Synthetic oligonucleotide
tgcacataagcaacagcaga

SEQ ID NO: 1531 - DNA, 24 bp, Artificial Sequence
  Synthetic oligonucleotide
cccgggttgtcttccgtcagatag

SEQ ID NO: 1532 - DNA, 70 bp, Artificial Sequence
  Synthetic oligonucleotide
aggatcgcctgtcagaagaggagacccgggttgtcttccgtcagatagtatctgctgttgcttatgtgca

SEQ ID NO: 1533 - DNA, 22 bp, Artificial Sequence
  Synthetic oligonucleotide
gacatttccagtcctgcagtca

SEQ ID NO: 1534 - DNA, 20 bp, Artificial Sequence
  Synthetic oligonucleotide
ctccgatcgcacacatttgt

SEQ ID NO: 1535 - DNA, 23 bp, Artificial Sequence
  Synthetic oligonucleotide
tgcctctctgccccaccctttgt

SEQ ID NO: 1536 - DNA, 86 bp, Artificial Sequence
  Synthetic oligonucleotide
gacatttccagtcctgcagtcaatgcctctctgccccaccctttgttcagtgtggctggtgccacgacaaatgtgtgcgatcggag

SEQ ID NO: 1537 - DNA, 20 bp, Artificial Sequence
  Synthetic oligonucleotide
gtgaaatgaaacgcaccaca

SEQ ID NO: 1538 - DNA, 20 bp, Artificial Sequence
  Synthetic oligonucleotide
gaccctgctcacaaccagac

SEQ ID NO: 1539 - DNA, 20 bp, Artificial Sequence
  Synthetic oligonucleotide
cagccctttggggaagctgg

SEQ ID NO: 1540 - DNA, 69 bp, Artificial Sequence
  Synthetic oligonucleotide
gtgaaatgaaacgcaccacactggacagccctttggggaagctggagctgtctggttgtgagcagggtc

SEQ ID NO: 1541 - DNA, 21 bp, Artificial Sequence
  Synthetic oligonucleotide
acggatctaccacaccattgc

SEQ ID NO: 1542 - DNA, 26 bp, Artificial Sequence
  Synthetic oligonucleotide
tccatatccaacaaaaaaactcaaag

SEQ ID NO: 1543 - DNA, 22 bp, Artificial Sequence
  Synthetic oligonucleotide
tttgacaccccttccccagcca

SEQ ID NO: 1544 - DNA, 79 bp, Artificial Sequence
  Synthetic oligonucleotide
acggatctaccacaccattgcatatttgacaccccttccccagccaaatagagctttgagtttttttgttggatatgga

SEQ ID NO: 1545 - DNA, 18 bp, Artificial Sequence
  Synthetic oligonucleotide
atggtgaatgtcacccgc

SEQ ID NO: 1546 - DNA, 18 bp, Artificial Sequence
  Synthetic oligonucleotide
aagccagaagccctgcat

SEQ ID NO: 1547 - DNA, 24 bp, Artificial Sequence
  Synthetic oligonucleotide
cgaggcctcagagggcaacattac

SEQ ID NO: 1548 - DNA, 68 bp, Artificial Sequence
  Synthetic oligonucleotide
atggtgaatgtcacccgcagcgaggcctcagagggcaacattaccgtgacatgcagggcttctggctt

SEQ ID NO: 1549 - DNA, 18 bp, Artificial Sequence
  Synthetic oligonucleotide
gattgcaccagggcagaa

SEQ ID NO: 1550 - DNA, 21 bp, Artificial Sequence
  Synthetic oligonucleotide
tccaaagtgcctctgctaaga

SEQ ID NO: 1551 - DNA, 24 bp, Artificial Sequence
  Synthetic oligonucleotide
ccactcttccttgaacaccctccc

SEQ ID NO: 1552 - DNA, 67 bp, Artificial Sequence
  Synthetic oligonucleotide
gattgcaccagggcagaacaggggagggtgttcaaggaagagtggctcttagcagaggcactttgga

SEQ ID NO: 1553 - DNA, 18 bp, Artificial Sequence
  Synthetic oligonucleotide
tgcttagctggcatgtgg

SEQ ID NO: 1554 - DNA, 19 bp, Artificial Sequence
  Synthetic oligonucleotide
cagcctactctccatgggc

SEQ ID NO: 1555 - DNA, 24 bp, Artificial Sequence
  Synthetic oligonucleotide
catgagatgccaggagacccttcc

SEQ ID NO: 1556 - DNA, 66 bp, Artificial Sequence
  Synthetic oligonucleotide
tgcttagctggcatgtggccgcatgagatgccaggagacccttccctgcccatggagagtaggctg

SEQ ID NO: 1557 - DNA, 20 bp, Artificial Sequence
  Synthetic oligonucleotide
cctggaggctgcaacatacc

SEQ ID NO: 1558 - DNA, 23 bp, Artificial Sequence
  Synthetic oligonucleotide
tacaatggctttggaggatagca

SEQ ID NO: 1559 - DNA, 25 bp, Artificial Sequence
  Synthetic oligonucleotide
atcctcctgaagcccttttcgcagc

SEQ ID NO: 1560 - DNA, 90 bp, Artificial Sequence
  Synthetic oligonucleotide
cctggaggctgcaacatacctcaatcctgtcccaggccggatcctcctgaagcccttttcgcagcactgctatcctccaaagccattgta

SEQ ID NO: 1561 - DNA, 20 bp, Artificial Sequence
  Synthetic oligonucleotide
cagccagaagcggaaactta

SEQ ID NO: 1562 - DNA, 19 bp, Artificial Sequence
  Synthetic oligonucleotide
agacaccatcacctgtgcc

SEQ ID NO: 1563 - DNA, 24 bp, Artificial Sequence
  Synthetic oligonucleotide
aagtccgaatctctgctccctgca

SEQ ID NO: 1564 - DNA, 66 bp, Artificial Sequence
  Synthetic oligonucleotide
cagccagaagcggaaacttaaaaagtccgaatctctgctccctgcagggcacaggtgatggtgtct

SEQ ID NO: 1565 - DNA, 26 bp, Artificial Sequence
  Synthetic oligonucleotide
ggatggtagcagtctagggattaact

SEQ ID NO: 1566 - DNA, 22 bp, Artificial Sequence
  Synthetic oligonucleotide
ggaatgtcccatacccaaagaa

SEQ ID NO: 1567 - DNA, 28 bp, Artificial Sequence
  Synthetic oligonucleotide
cctgtatgctgcaactcatgaacttggc

SEQ ID NO: 1568 - DNA, 79 bp, Artificial Sequence
  Synthetic oligonucleotide
ggatggtagcagtctagggattaacttcctgtatgctgcaactcatgaacttggccattctttgggtatgggacattcc

SEQ ID NO: 1569 - DNA, 20 bp, Artificial Sequence
  Synthetic oligonucleotide
gagaaccaatctcaccgaca

SEQ ID NO: 1570 - DNA, 20 bp, Artificial Sequence
  Synthetic oligonucleotide
cacccgagtgtaaccatagc

SEQ ID NO: 1571 - DNA, 24 bp, Artificial Sequence
  Synthetic oligonucleotide
acaggtattcctctgccagctgcc

SEQ ID NO: 1572 - DNA, 67 bp, Artificial Sequence
  Synthetic oligonucleotide
gagaaccaatctcaccgacaggcagctggcagaggaatacctgtaccgctatggttacactcgggtg

SEQ ID NO: 1573 - DNA, 19 bp, Artificial Sequence
  Synthetic oligonucleotide
ccgaccaaccctccaatta

SEQ ID NO: 1574 - DNA, 21 bp, Artificial Sequence
  Synthetic oligonucleotide
agggcatttagagcttcagga

SEQ ID NO: 1575 - DNA, 24 bp, Artificial Sequence
  Synthetic oligonucleotide
atttgaccttccaaacccacaggg

SEQ ID NO: 1576 - DNA, 66 bp, Artificial Sequence
  Synthetic oligonucleotide
ccgaccaaccctccaattatatttgaccttccaaacccacagggttcctgaagctctaaatgccct

SEQ ID NO: 1577 - DNA, 22 bp, Artificial Sequence
  Synthetic oligonucleotide
cttgacctcaggactctggatt

SEQ ID NO: 1578 - DNA, 18 bp, Artificial Sequence
  Synthetic oligonucleotide
ggactgcggtcactccac

SEQ ID NO: 1579 - DNA, 24 bp, Artificial Sequence
  Synthetic oligonucleotide
ccaaccgctgttgaagctcagact

SEQ ID NO: 1580 - DNA, 75 bp, Artificial Sequence
  Synthetic oligonucleotide
cttgacctcaggactctggattggacttaacagtctgagcttcaacagcggttggcagtggagtgaccgcagtcc

SEQ ID NO: 1581 - DNA, 19 bp, Artificial Sequence
  Synthetic oligonucleotide
tccggttcccttcgtttag

SEQ ID NO: 1582 - DNA, 20 bp, Artificial Sequence
  Synthetic oligonucleotide
gtggaaaaactgcggaaaac

SEQ ID NO: 1583 - DNA, 24 bp, Artificial Sequence
  Synthetic oligonucleotide
cggctggaaattatgtcctccgtc

SEQ ID NO: 1584 - DNA, 66 bp, Artificial Sequence
  Synthetic oligonucleotide
tccggttcccttcgtttaggtcggctggaaattatgtcctccgtcggttttccgcagtttttccac

SEQ ID NO: 1585 - DNA, 20 bp, Artificial Sequence
  Synthetic oligonucleotide
gatgcagaattgaggcagac

SEQ ID NO: 1586 - DNA, 20 bp, Artificial Sequence
  Synthetic oligonucleotide
tcttggcaagtcggttaaga

SEQ ID NO: 1587 - DNA, 29 bp, Artificial Sequence
  Synthetic oligonucleotide
caagaagatttacttcgtcgattcccaga

SEQ ID NO: 1588 - DNA, 73 bp, Artificial Sequence
  Synthetic oligonucleotide
gatgcagaattgaggcagactttacaagaagatttacttcgtcgattcccagatcttaaccgacttgccaaga

SEQ ID NO: 1589 - DNA, 21 bp, Artificial Sequence
  Synthetic oligonucleotide
tgattaccatcatggctcaga

SEQ ID NO: 1590 - DNA, 20 bp, Artificial Sequence
  Synthetic oligonucleotide
cttgtgaaaatgccatccac

SEQ ID NO: 1591 - DNA, 24 bp, Artificial Sequence
  Synthetic oligonucleotide
tcccaattgtcgcttcttctgcag

SEQ ID NO: 1592 - DNA, 82 bp, Artificial Sequence
  Synthetic oligonucleotide
tgattaccatcatggctcagattggctcctatgttcctgcagaagaagcgacaattgggattgtggatggcattttcacaag

SEQ ID NO: 1593 - DNA, 20 bp, Artificial Sequence
  Synthetic oligonucleotide
tctattgggggattggtagg

SEQ ID NO: 1594 - DNA, 20 bp, Artificial Sequence
  Synthetic oligonucleotide
caaattgcgagtggtgaaat

SEQ ID NO: 1595 - DNA, 26 bp, Artificial Sequence
  Synthetic oligonucleotide
ccgttaccagctggaaattcctgaga

SEQ ID NO: 1596 - DNA, 68 bp, Artificial Sequence
  Synthetic oligonucleotide
tctattgggggattggtaggaaccgttaccagctggaaattcctgagaatttcaccactcgcaatttg

SEQ ID NO: 1597 - DNA, 19 bp, Artificial Sequence
  Synthetic oligonucleotide
ccgccctcacctgaagaga

SEQ ID NO: 1598 - DNA, 22 bp, Artificial Sequence
  Synthetic oligonucleotide
ggaataagttagccgcgcttct

SEQ ID NO: 1599 - DNA, 21 bp, Artificial Sequence
  Synthetic oligonucleotide
cccagtgtccgccaaggagcg

SEQ ID NO: 1600 - DNA, 77 bp, Artificial Sequence
  Synthetic oligonucleotide
ccgccctcacctgcagagaaacgcgctccttggcggacactgggggaggagaggaagaagcgcggctaacttattcc

SEQ ID NO: 1601 - DNA, 20 bp, Artificial Sequence
  Synthetic oligonucleotide
ggtggaaggaaacctcttca

SEQ ID NO: 1602 - DNA, 19 bp, Artificial Sequence
  Synthetic oligonucleotide
cagcagcagaaattccagg

SEQ ID NO: 1603 - DNA, 24 bp, Artificial Sequence
  Synthetic oligonucleotide
aagctgcccacaatctgctgcata

SEQ ID NO: 1604 - DNA, 69 bp, Artificial Sequence
  Synthetic oligonucleotide
ggtggaaggaaacctcttcattatgcagcagattgtgggcagcttgaaatcctggaatttctgctgctg

SEQ ID NO: 1605 - DNA, 20 bp, Artificial Sequence
  Synthetic oligonucleotide
ttcgacaagtcctccaccat

SEQ ID NO: 1606 - DNA, 20 bp, Artificial Sequence
  Synthetic oligonucleotide
cttggaacatccgtcggtag

SEQ ID NO: 1607 - DNA, 24 bp, Artificial Sequence
  Synthetic oligonucleotide
ccaagaaacagcgacatcagccag

SEQ ID NO: 1608 - DNA, 67 bp, Artificial Sequence
  Synthetic oligonucleotide
ttcgacaagtcctccaccattccaagaaacagcgacatcagccagtcctaccgacggatgttccaag

SEQ ID NO: 1609 - DNA, 20 bp, Artificial Sequence
  Synthetic oligonucleotide
ggccaggatctgtggtggta

SEQ ID NO: 1610 - DNA, 20 bp, Artificial Sequence
  Synthetic oligonucleotide
ctccacgtcgtggacattga

SEQ ID NO: 1611 - DNA, 23 bp, Artificial Sequence
  Synthetic oligonucleotide
ctctggccttccgagaaggtacc

SEQ ID NO: 1612 - DNA, 71 bp, Artificial Sequence
  Synthetic oligonucleotide
ggccaggatctgtggtggtacaattgactctggccttccgagaaggtaccatcaatgtccacgacgtggag

SEQ ID NO: 1613 - DNA, 22 bp, Artificial Sequence
  Synthetic oligonucleotide
acgagaacgagggcatctatgt

SEQ ID NO: 1614 - DNA, 22 bp, Artificial Sequence
  Synthetic oligonucleotide
gcatgtaggtgcttccaatcac

SEQ ID NO: 1615 - DNA, 25 bp, Artificial Sequence
  Synthetic oligonucleotide
cgcacctttccggtcttgacatcct

SEQ ID NO: 1616 - DNA, 75 bp, Artificial Sequence
  Synthetic oligonucleotide
acgagaacgagggcatctatgtgcaggatgtcaagaccggaaaggtgcgcgctgtgattggaagcacctacatgc

SEQ ID NO: 1617 - DNA, 18 bp, Artificial Sequence
  Synthetic oligonucleotide
gccgagatcgccaagatg

SEQ ID NO: 1618 - DNA, 27 bp, Artificial Sequence
  Synthetic oligonucleotide
cttttgatggtagagttccagtgattc

SEQ ID NO: 1619 - DNA, 24 bp, Artificial Sequence
  Synthetic oligonucleotide
cagcattgtctgtcctccctggca

SEQ ID NO: 1620 - DNA, 74 bp, Artificial Sequence
  Synthetic oligonucleotide
gccgagatcgccaagatgttgccagggaggacagacaatgctgtgaagaatcactggaactctaccatcaaaag

SEQ ID NO: 1621 - DNA, 20 bp, Artificial Sequence
  Synthetic oligonucleotide
cagcaaccagggagtctgta

SEQ ID NO: 1622 - DNA, 20 bp, Artificial Sequence
  Synthetic oligonucleotide
cagcagtaagtgcctccatc

SEQ ID NO: 1623 - DNA, 23 bp, Artificial Sequence
  Synthetic oligonucleotide
aaattcgcaagcccagcccctat

SEQ ID NO: 1624 - DNA, 69 bp, Artificial Sequence
  Synthetic oligonucleotide
cagcaaccagggagtctgtaccctggaaattcgcaagcccagcccctatgatggaggcacttactgctg

SEQ ID NO: 1625 - DNA, 21 bp, Artificial Sequence
  Synthetic oligonucleotide
tccctccactcggaaggacta

SEQ ID NO: 1626 - DNA, 22 bp, Artificial Sequence
  Synthetic oligonucleotide
cggttgttgctgatctgtctca

SEQ ID NO: 1627 - DNA, 27 bp, Artificial Sequence
  Synthetic oligonucleotide
tctgacactgtccaacttgaccctctt

SEQ ID NO: 1628 - DNA, 84 bp, Artificial Sequence
  Synthetic oligonucleotide
tccctccactcggaaggactatcctgctgccaagagggtcaagttggacagtgtcagagtcctgagacagatcagcaacaaccg

SEQ ID NO: 1629 - DNA, 20 bp, Artificial Sequence
  Synthetic oligonucleotide
cacctgactgagctggatgt

SEQ ID NO: 1630 - DNA, 20 bp, Artificial Sequence
  Synthetic oligonucleotide
gatgtagtgctggtgcaggt

SEQ ID NO: 1631 - DNA, 24 bp, Artificial Sequence
  Synthetic oligonucleotide
cacaccctcacagatctgcctggt

SEQ ID NO: 1632 - DNA, 78 bp, Artificial Sequence
  Synthetic oligonucleotide
cacctgactgagctggatgtggtcctgttcaccaggcagatctgtgagggtgtgcattacctgcaccagcactacatc

SEQ ID NO: 1633 - DNA, 20 bp, Artificial Sequence
  Synthetic oligonucleotide
aagcagttctggagcaggag

SEQ ID NO: 1634 - DNA, 20 bp, Artificial Sequence
  Synthetic oligonucleotide
gatgagctcggcttcactct

SEQ ID NO: 1635 - DNA, 21 bp, Artificial Sequence
  Synthetic oligonucleotide
caatcctcagggccagctccc

SEQ ID NO: 1636 - DNA, 74 bp, Artificial Sequence
  Synthetic oligonucleotide
aagcagttctggagcaggagcgcagggaccgggagctggccctgaggattgcccagagtgaagccgagctcatc

SEQ ID NO: 1637 - DNA, 20 bp, Artificial Sequence
  Synthetic oligonucleotide
tagttcccagctgaccatca

SEQ ID NO: 1638 - DNA, 20 bp, Artificial Sequence
  Synthetic oligonucleotide
cagccttgttctcagcaatg

SEQ ID NO: 1639 - DNA, 25 bp, Artificial Sequence
  Synthetic oligonucleotide
ctcagcctcgtcgttcttatccacc

SEQ ID NO: 1640 - DNA, 77 bp, Artificial Sequence
  Synthetic oligonucleotide
tagttcccagctgaccatcaaaaaggtggataagaacgacgaggctgagtacatctgcattgctgagaacaaggctg

SEQ ID NO: 1641 - DNA, 19 bp, Artificial Sequence
  Synthetic oligonucleotide
tcgttgcttagacaaggcg

SEQ ID NO: 1642 - DNA, 20 bp, Artificial Sequence
  Synthetic oligonucleotide
ctccagacagtgtgcaaagc

SEQ ID NO: 1643 - DNA, 24 bp, Artificial Sequence
  Synthetic oligonucleotide
ctactgtccgcagcaaggcactgt

SEQ ID NO: 1644 - DNA, 67 bp, Artificial Sequence
  Synthetic oligonucleotide
tcgttgcttagacaaggcgcctactgtccgcagcaaggcactgtccagctttgcacactgtctggag

SEQ ID NO: 1645 - DNA, 20 bp, Artificial Sequence
  Synthetic oligonucleotide
aaccgttacagcccagaatc

SEQ ID NO: 1646 - DNA, 20 bp, Artificial Sequence
  Synthetic oligonucleotide
tctggagagacccttgaacc

SEQ ID NO: 1647 - DNA, 24 bp, Artificial Sequence
  Synthetic oligonucleotide
ccaggctcagtctgtccatcatca

SEQ ID NO: 1648 - DNA, 71 bp, Artificial Sequence
  Synthetic oligonucleotide
aaccgttacagcccagaatcccaggctcagtctgtccatcatcaaagaccaggttcaagggtctctccaga

SEQ ID NO: 1649 - DNA, 20 bp, Artificial Sequence
  Synthetic oligonucleotide
cgtcatctacgaaggcaaga

SEQ ID NO: 1650 - DNA, 20 bp, Artificial Sequence
  Synthetic oligonucleotide
gagcactgggtcacagacat

SEQ ID NO: 1651 - DNA, 24 bp, Artificial Sequence
  Synthetic oligonucleotide
cctcataggacaagacgtggccct

SEQ ID NO: 1652 - DNA, 69 bp, Artificial Sequence
  Synthetic oligonucleotide
cgtcatctacgaaggcaagaagggccacgtcttgtcctatgagggtggcatgtctgtgacccagtgctc

SEQ ID NO: 1653 - DNA, 18 bp, Artificial Sequence
  Synthetic oligonucleotide
agggcaacattccacagc

SEQ ID NO: 1654 - DNA, 18 bp, Artificial Sequence
  Synthetic oligonucleotide
cagtgctcctactccggc

SEQ ID NO: 1655 - DNA, 24 bp, Artificial Sequence
  Synthetic oligonucleotide
ctgcaaggacactcatcacagcca

SEQ ID NO: 1656 - DNA, 67 bp, Artificial Sequence
  Synthetic oligonucleotide
agggcaacattccacagctgccctggctgtgatgagtgtccttgcaggggccggagtaggagcactg

SEQ ID NO: 1657 - DNA, 20 bp, Artificial Sequence
  Synthetic oligonucleotide
agaagagtcaagggcacgag

SEQ ID NO: 1658 - DNA, 18 bp, Artificial Sequence
  Synthetic oligonucleotide
aggccgaaccttttctgg

SEQ ID NO: 1659 - DNA, 24 bp, Artificial Sequence
  Synthetic oligonucleotide
tgtccaagaaaggcatggctaccc

SEQ ID NO: 1660 - DNA, 67 bp, Artificial Sequence
  Synthetic oligonucleotide
agaagagtcaagggcacgagcatcgggtagccatgcctttcttggacatccagaaaaggttcggcct

SEQ ID NO: 1661 - DNA, 18 bp, Artificial Sequence
  Synthetic oligonucleotide
gtgaggcagcgcgactct

SEQ ID NO: 1662 - DNA, 23 bp, Artificial Sequence
  Synthetic oligonucleotide
tgccaatggtgtacaacacttca

SEQ ID NO: 1663 - DNA, 21 bp, Artificial Sequence
  Synthetic oligonucleotide
tgccttcccgggctgaggact

SEQ ID NO: 1664 - DNA, 79 bp, Artificial Sequence
  Synthetic oligonucleotide
gtgaggcagcgcgactctggcgactggccggccatgccttcccgggctgaggactatgaagtgttgtacaccattggca

SEQ ID NO: 1665 - DNA, 20 bp, Artificial Sequence
  Synthetic oligonucleotide
ccagggcaccatactgtttc

SEQ ID NO: 1666 - DNA, 22 bp, Artificial Sequence
  Synthetic oligonucleotide
aacggtaaatcaaggtcttcgt

SEQ ID NO: 1667 - DNA, 24 bp, Artificial Sequence
  Synthetic oligonucleotide
agccaacccttttctcccatcaca

SEQ ID NO: 1668 - DNA, 73 bp, Artificial Sequence
  Synthetic oligonucleotide
ccagggcaccatactgtttccagcagccaacccttttctcccatcacaactacgaagaccttgatttaccgtt

SEQ ID NO: 1669 - DNA, 21 bp, Artificial Sequence
  Synthetic oligonucleotide
aggaggaggaagaaggtagca

SEQ ID NO: 1670 - DNA, 20 bp, Artificial Sequence
  Synthetic oligonucleotide
gagctcctgatctggtttgc

SEQ ID NO: 1671 - DNA, 25 bp, Artificial Sequence
  Synthetic oligonucleotide
tcatcttcagcagtggagccattca

SEQ ID NO: 1672 - DNA, 72 bp, Artificial Sequence
  Synthetic oligonucleotide
aggaggaggaagaaggtagcatcatgaatggctccactgctgaagatgaagagcaaaccagatcaggagctc

SEQ ID NO: 1673 - DNA, 19 bp, Artificial Sequence
  Synthetic oligonucleotide
ctgaacccctctcctggtc

SEQ ID NO: 1674 - DNA, 18 bp, Artificial Sequence
  Synthetic oligonucleotide
aggaaacgatggcgaggt

SEQ ID NO: 1675 - DNA, 24 bp, Artificial Sequence
  Synthetic oligonucleotide
cgagaatcagtccccgtggagttc

SEQ ID NO: 1676 - DNA, 70 bp, Artificial Sequence
  Synthetic oligonucleotide
ctgaacccctctcctggtcaccgagaatcagtccccgtggagttccccctccacctcgccatcgtttcct

SEQ ID NO: 1677 - DNA, 21 bp, Artificial Sequence
  Synthetic oligonucleotide
cagtcaaggtcagaggctgag

SEQ ID NO: 1678 - DNA, 18 bp, Artificial Sequence
  Synthetic oligonucleotide
ctttggctcgtggcattc

SEQ ID NO: 1679 - DNA, 24 bp, Artificial Sequence
  Synthetic oligonucleotide
cgggttcctaccccacagtcattc

SEQ ID NO: 1680 - DNA, 72 bp, Artificial Sequence
  Synthetic oligonucleotide
cagtcaaggtcagaggctgagcccgggttcctaccccacagtcattcagcagcagaatgccacgagccaaag

SEQ ID NO: 1681 - DNA, 20 bp, Artificial Sequence
  Synthetic oligonucleotide
cagaccaaggagatggacct

SEQ ID NO: 1682 - DNA, 18 bp, Artificial Sequence
  Synthetic oligonucleotide
agctgccagtgctatccg

SEQ ID NO: 1683 - DNA, 24 bp, Artificial Sequence
  Synthetic oligonucleotide
aagctgtaaacatgagccgcacca

SEQ ID NO: 1684 - DNA, 73 bp, Artificial Sequence
  Synthetic oligonucleotide
cagaccaaggagatggacctcagcgtggtgcggctcatgtttacagcttttcttccggatagcactggcagct

SEQ ID NO: 1685 - DNA, 18 bp, Artificial Sequence
  Synthetic oligonucleotide
ctactggacgaccgccac

SEQ ID NO: 1686 - DNA, 21 bp, Artificial Sequence
  Synthetic oligonucleotide
ccttgaccatctgctcgtact

SEQ ID NO: 1687 - DNA, 24 bp, Artificial Sequence
  Synthetic oligonucleotide
ctcgtctttcatggagtccaggcc

SEQ ID NO: 1688 - DNA, 70 bp, Artificial Sequence
  Synthetic oligonucleotide
ctactggacgaccgccacgacagcggcctggactccatgaaagacgaggagtacgagcagatggtcaagg

SEQ ID NO: 1689 - DNA, 19 bp, Artificial Sequence
  Synthetic oligonucleotide
ccaaccctgcagactccaa

SEQ ID NO: 1690 - DNA, 28 bp, Artificial Sequence
  Synthetic oligonucleotide
atgtataatgttcctgccaacttgtatg

SEQ ID NO: 1691 - DNA, 25 bp, Artificial Sequence
  Synthetic oligonucleotide
cctgggaccatccgtggagacttct

SEQ ID NO: 1692 - DNA, 74 bp, Artificial Sequence
  Synthetic oligonucleotide
ccaaccctgcagactccaagcctgggaccatccgtggagacttctgcatacaagttggcaggaacattatacat

SEQ ID NO: 1693 - DNA, 18 bp, Artificial Sequence
  Synthetic oligonucleotide
cctagggcagggatggag

SEQ ID NO: 1694 - DNA, 20 bp, Artificial Sequence
  Synthetic oligonucleotide
ctagtccagccaaacatccc

SEQ ID NO: 1695 - DNA, 24 bp, Artificial Sequence
  Synthetic oligonucleotide
ccctctcctcatgcccagactctc

SEQ ID NO: 1696 - DNA, 67 bp, Artificial Sequence
  Synthetic oligonucleotide
cctagggcagggatggagagagagtctgggcatgaggagagggtctcgggatgtttggctggactag

SEQ ID NO: 1697 - DNA, 18 bp, Artificial Sequence
  Synthetic oligonucleotide
atctccgcctcgctcatg

SEQ ID NO: 1698 - DNA, 21 bp, Artificial Sequence
  Synthetic oligonucleotide
tcggagccatacaggattgtc

SEQ ID NO: 1699 - DNA, 22 bp, Artificial Sequence
  Synthetic oligonucleotide
ttcactcgcttcgccatcaccg

SEQ ID NO: 1700 - DNA, 68 bp, Artificial Sequence
  Synthetic oligonucleotide
atctccgcctcgctcatgggcacggtgatggcgaagcgagtgaaggcgacaatcctgtatggctccga

SEQ ID NO: 1701 - DNA, 20 bp, Artificial Sequence
  Synthetic oligonucleotide
cctcaactgcagccttatcc

SEQ ID NO: 1702 - DNA, 20 bp, Artificial Sequence
  Synthetic oligonucleotide
tgcttggaaccttctgtgat

SEQ ID NO: 1703 - DNA, 24 bp, Artificial Sequence
  Synthetic oligonucleotide
ccgaacactcttggcttacctccg

SEQ ID NO: 1704 - DNA, 80 bp, Artificial Sequence
  Synthetic oligonucleotide
cctcaactgcagccttatccttttacccatgtgccgaacactcttggcttacctccgaggatcacagaaggttccaagca

SEQ ID NO: 1705 - DNA, 20 bp, Artificial Sequence
  Synthetic oligonucleotide
tcaccaacctgttcatcctc

SEQ ID NO: 1706 - DNA, 18 bp, Artificial Sequence
  Synthetic oligonucleotide
gatgttgatgggcagcac

SEQ ID NO: 1707 - DNA, 21 bp, Artificial Sequence
  Synthetic oligonucleotide
atcgccgacgagctcttcacg

SEQ ID NO: 1708 - DNA, 71 bp, Artificial Sequence
  Synthetic oligonucleotide
tcaccaacctgttcatcctcaacctggccatcgccgacgagctcttcacgctggtgctgcccatcaacatc

SEQ ID NO: 1709 - DNA, 22 bp, Artificial Sequence
  Synthetic oligonucleotide
aatgttgtccaggttctattgc

SEQ ID NO: 1710 - DNA, 19 bp, Artificial Sequence
  Synthetic oligonucleotide
caagcaaagggtggagttc

SEQ ID NO: 1711 - DNA, 28 bp, Artificial Sequence
  Synthetic oligonucleotide
aacaggcattttggacaacacattcttg

SEQ ID NO: 1712 - DNA, 84 bp, Artificial Sequence
  Synthetic oligonucleotide
aatgttgtccaggttctattgccaagaatgtgttgtccaaaatgcctgtttagtttttaaagatggaactccaccctttgcttg

SEQ ID NO: 1713 - DNA, 27 bp, Artificial Sequence
  Synthetic oligonucleotide
cgagactctcctcatagtgaaaggtat

SEQ ID NO: 1714 - DNA, 22 bp, Artificial Sequence
  Synthetic oligonucleotide
cttggcgtgtggaaatctacag

SEQ ID NO: 1715 - DNA, 24 bp, Artificial Sequence
  Synthetic oligonucleotide
atgaccaccccggctcgtatgtca

SEQ ID NO: 1716 - DNA, 83 bp, Artificial Sequence
  Synthetic oligonucleotide
cgagactctcctcatagtgaaaggtatgtgtcagccatgaccaccccggctcgtatgtcacctgtagatttccacacgccaag

SEQ ID NO: 1717 - DNA, 19 bp, Artificial Sequence
  Synthetic oligonucleotide
cccacaagcatgaaggaga

SEQ ID NO: 1718 - DNA, 19 bp, Artificial Sequence
  Synthetic oligonucleotide
tgctcaatctggcccacta

SEQ ID NO: 1719 - DNA, 24 bp, Artificial Sequence
  Synthetic oligonucleotide
agctttctctaccccggcatctca

SEQ ID NO: 1720 - DNA, 67 bp, Artificial Sequence
  Synthetic oligonucleotide
cccacaagcatgaaggagaaaagctttctctaccccggcatctcaaagtagtgggccagattgagca

SEQ ID NO: 1721 - DNA, 20 bp, Artificial Sequence
  Synthetic oligonucleotide
cagctctctccacgcgattc

SEQ ID NO: 1722 - DNA, 19 bp, Artificial Sequence
  Synthetic oligonucleotide
cccagcagctccattctga

SEQ ID NO: 1723 - DNA, 28 bp, Artificial Sequence
  Synthetic oligonucleotide
caggatctaccccgagagagccactcat

SEQ ID NO: 1724 - DNA, 82 bp, Artificial Sequence
  Synthetic oligonucleotide
cagctctctccacgcgattcatcaggatctaccccgagagagccactcatggcggactggggctcagaatggagctgctggg

SEQ ID NO: 1725 - DNA, 20 bp, Artificial Sequence
  Synthetic oligonucleotide
agcctctttgcgtcaatagc

SEQ ID NO: 1726 - DNA, 20 bp, Artificial Sequence
  Synthetic oligonucleotide
ctgtggtcacaggggtacag

SEQ ID NO: 1727 - DNA, 24 bp, Artificial Sequence
  Synthetic oligonucleotide
tcatctgccaccactggactctcc

SEQ ID NO: 1728 - DNA, 79 bp, Artificial Sequence
  Synthetic oligonucleotide
agcctctttgcgtcaatagcaactgctccaacctcatctgccaccactggactctccctctgtacccctgtgaccacag

SEQ ID NO: 1729 - DNA, 20 bp, Artificial Sequence
  Synthetic oligonucleotide
agcaaggacagctttgcagt

SEQ ID NO: 1730 - DNA, 18 bp, Artificial Sequence
  Synthetic oligonucleotide
gaagacatggtcggctcg

SEQ ID NO: 1731 - DNA, 24 bp, Artificial Sequence
  Synthetic oligonucleotide
ctgctcctcagcgaactccaggag

SEQ ID NO: 1732 - DNA, 66 bp, Artificial Sequence
  Synthetic oligonucleotide
agcaaggacagctttgcagttctcctggagttcgctgaggagcagctgcgagccgaccatgtcttc

SEQ ID NO: 1733 - DNA, 18 bp, Artificial Sequence
  Synthetic oligonucleotide
ccctcccatccgagtttc

SEQ ID NO: 1734 - DNA, 18 bp, Artificial Sequence
  Synthetic oligonucleotide
gacgcgggagtgtaggtg

SEQ ID NO: 1735 - DNA, 24 bp, Artificial Sequence
  Synthetic oligonucleotide
ctcctccctcggtgaccaattcac

SEQ ID NO: 1736 - DNA, 74 bp, Artificial Sequence
  Synthetic oligonucleotide
ccctcccatccgagtttcaggtgaattggtcaccgagggaggaggccgacacaccacacctacactcccgcgtc

SEQ ID NO: 1737 - DNA, 21 bp, Artificial Sequence
  Synthetic oligonucleotide
agagatcaccggcgtaatcaa

SEQ ID NO: 1738 - DNA, 21 bp, Artificial Sequence
  Synthetic oligonucleotide
cgggctcagctatgattctca

SEQ ID NO: 1739 - DNA, 27 bp, Artificial Sequence
  Synthetic oligonucleotide
ccagcgttggacaaatactttccgtca

SEQ ID NO: 1740 - DNA, 80 bp, Artificial Sequence
  Synthetic oligonucleotide
agagatcaccggcgtaatcaacccagcgttggacaaatactttccgtcagactctggagtgagaatcatagctgagcccg

SEQ ID NO: 1741 - DNA, 20 bp, Artificial Sequence
  Synthetic oligonucleotide
catgttggaaggagcgttct

SEQ ID NO: 1742 - DNA, 20 bp, Artificial Sequence
  Synthetic oligonucleotide
caccagtttggtggtgactg

SEQ ID NO: 1743 - DNA, 24 bp, Artificial Sequence
  Synthetic oligonucleotide
tggcctggatctcctgaagctaca

SEQ ID NO: 1744 - DNA, 67 bp, Artificial Sequence
  Synthetic oligonucleotide
catgttggaaggagcgttctatggcctggatctcctgaagctacattcagtcaccaccaaactggtg

SEQ ID NO: 1745 - DNA, 19 bp, Artificial Sequence
  Synthetic oligonucleotide
tcagaactgaggccgacac

SEQ ID NO: 1746 - DNA, 21 bp, Artificial Sequence
  Synthetic oligonucleotide
ccagatagtctacctcccgct

SEQ ID NO: 1747 - DNA, 24 bp, Artificial Sequence
  Synthetic oligonucleotide
cagacgatccactctcccggagat

SEQ ID NO: 1748 - DNA, 66 bp, Artificial Sequence
  Synthetic oligonucleotide
tcagaactgaggccgacaccatctccgggagagtggatcgtctggagcgggaggtagactatctgg

SEQ ID NO: 1749 - DNA, 21 bp, Artificial Sequence
  Synthetic oligonucleotide
cgcaaactcaagactatccca

SEQ ID NO: 1750 - DNA, 22 bp, Artificial Sequence
  Synthetic oligonucleotide
cagtcacagcctcaatttcatt

SEQ ID NO: 1751 - DNA, 26 bp, Artificial Sequence
  Synthetic oligonucleotide
tccgatgcacattcagcaactctacc

SEQ ID NO: 1752 - DNA, 82 bp, Artificial Sequence
  Synthetic oligonucleotide
cgcaaactcaagactatcccaaatattccgatgcacattcagcaactctaccttcagttcaatgaaattgaggctgtgactg

SEQ ID NO: 1753 - DNA, 19 bp, Artificial Sequence
  Synthetic oligonucleotide
gcatgctttcaggcattga

SEQ ID NO: 1754 - DNA, 20 bp, Artificial Sequence
  Synthetic oligonucleotide
agaagatggccagcattttg

SEQ ID NO: 1755 - DNA, 24 bp, Artificial Sequence
  Synthetic oligonucleotide
tcctcatctccacctcatccatgc

SEQ ID NO: 1756 - DNA, 66 bp, Artificial Sequence
  Synthetic oligonucleotide
gcatgctttcaggcattgacatcctcatctccacctcatccatgcccaaaatgctggccatcttct

SEQ ID NO: 1757 - DNA, 20 bp, Artificial Sequence
  Synthetic oligonucleotide
tatggtgccaaaaccaaaca

SEQ ID NO: 1758 - DNA, 22 bp, Artificial Sequence
  Synthetic oligonucleotide
gtccttgtcacagctgatcttg

SEQ ID NO: 1759 - DNA, 24 bp, Artificial Sequence
  Synthetic oligonucleotide
acatagccagcacccgtgttctga

SEQ ID NO: 1760 - DNA, 69 bp, Artificial Sequence
  Synthetic oligonucleotide
tatggtgccaaaaccaaacagatcagaacacgggtgctggctatgttcaagatcagctgtgacaaggac

SEQ ID NO: 1761 - DNA, 20 bp, Artificial Sequence
  Synthetic oligonucleotide
gtttctgaaggggaggtcac

SEQ ID NO: 1762 - DNA, 19 bp, Artificial Sequence
  Synthetic oligonucleotide
aggtgtctggtttgggaca

SEQ ID NO: 1763 - DNA, 24 bp, Artificial Sequence
  Synthetic oligonucleotide
ctgagctggcctcctatgcctcat

SEQ ID NO: 1764 - DNA, 68 bp, Artificial Sequence
  Synthetic oligonucleotide
gtttctgaaggggaggtcacagcctgagctggcctcctatgcctcatcatgtcccaaaccagacacct

SEQ ID NO: 1765 - DNA, 20 bp, Artificial Sequence
  Synthetic oligonucleotide
caacctgacgaagtggaatc

SEQ ID NO: 1766 - DNA, 20 bp, Artificial Sequence
  Synthetic oligonucleotide
cagatgctccctcatcctct

SEQ ID NO: 1767 - DNA, 29 bp, Artificial Sequence
  Synthetic oligonucleotide
ccaactcaaagtcaggattctacacctgc

SEQ ID NO: 1768 - DNA, 79 bp, Artificial Sequence
  Synthetic oligonucleotide
caacctgacgaagtggaatcaccaactcaaagtcaggattctacacctgctgaagagagagaggatgagggagcatctg

SEQ ID NO: 1769 - DNA, 21 bp, Artificial Sequence
  Synthetic oligonucleotide
gaatctcagcaagaggaacca

SEQ ID NO: 1770 - DNA, 20 bp, Artificial Sequence
  Synthetic oligonucleotide
gttcttcgatcggaggtgtt

SEQ ID NO: 1771 - DNA, 29 bp, Artificial Sequence
  Synthetic oligonucleotide
ccaactgacaatcaggatattgaacctgg

SEQ ID NO: 1772 - DNA, 85 bp, Artificial Sequence
  Synthetic oligonucleotide
gaatctcagcaagaggaaccaccaactgacaatcaggatattgaacctggacaagagagagaaggaacacctccgatcgaagaac

SEQ ID NO: 1773 - DNA, 18 bp, Artificial Sequence
  Synthetic oligonucleotide
cctccaggtcacccacag

SEQ ID NO: 1774 - DNA, 20 bp, Artificial Sequence
  Synthetic oligonucleotide
gtcccttcaggccagaactt

SEQ ID NO: 1775 - DNA, 24 bp, Artificial Sequence
  Synthetic oligonucleotide
agtttcaggaaggctgcccctctc

SEQ ID NO: 1776 - DNA, 71 bp, Artificial Sequence
  Synthetic oligonucleotide
cctccaggtcacccacagccagtttcaggaaggctgcccctctctcccactaagttctggcctgaagggac

SEQ ID NO: 1777 - DNA, 22 bp, Artificial Sequence
  Synthetic oligonucleotide
tggtaatccctggttaaccttc

SEQ ID NO: 1778 - DNA, 20 bp, Artificial Sequence
  Synthetic oligonucleotide
tccaccttatgcctttcaca

SEQ ID NO: 1779 - DNA, 24 bp, Artificial Sequence
  Synthetic oligonucleotide
cagcacagttctttaggcagccca

SEQ ID NO: 1780 - DNA, 68 bp, Artificial Sequence
  Synthetic oligonucleotide
tggtaatccctggttaaccttcatgggctgcctaaagaactgtgctgatgtgaaaggcataaggtgga

SEQ ID NO: 1781 - DNA, 20 bp, Artificial Sequence
  Synthetic oligonucleotide
cgtgattgtcaggagcaaga

SEQ ID NO: 1782 - DNA, 20 bp, Artificial Sequence
  Synthetic oligonucleotide
agaaaggggagatgcagagg

SEQ ID NO: 1783 - DNA, 24 bp, Artificial Sequence
  Synthetic oligonucleotide
ctgagatgctccctgccttcagtg

SEQ ID NO: 1784 - DNA, 66 bp, Artificial Sequence
  Synthetic oligonucleotide
cgtgattgtcaggagcaagacctgagatgctccctgccttcagtgtcctctgcatctcccctttct

SEQ ID NO: 1785 - DNA, 18 bp, Artificial Sequence
  Synthetic oligonucleotide
cccagcgttgaagcagat

SEQ ID NO: 1786 - DNA, 18 bp, Artificial Sequence
  Synthetic oligonucleotide
gaaacgccagtccgtgtt

SEQ ID NO: 1787 - DNA, 23 bp, Artificial Sequence
  Synthetic oligonucleotide
attcttaaacagcaagccccgcc

SEQ ID NO: 1788 - DNA, 66 bp, Artificial Sequence
  Synthetic oligonucleotide
cccagcgttgaagcagataagaagattcttaaacagcaagccccgcccaacacggactggcgtttc

SEQ ID NO: 1789 - DNA, 22 bp, Artificial Sequence
  Synthetic oligonucleotide
gaaggtgttggaggcactcaag

SEQ ID NO: 1790 - DNA, 21 bp, Artificial Sequence
  Synthetic oligonucleotide
ggtttacaccgctggagctaa

SEQ ID NO: 1791 - DNA, 24 bp, Artificial Sequence
  Synthetic oligonucleotide
atcccagcaggcctcgttgatgag

SEQ ID NO: 1792 - DNA, 71 bp, Artificial Sequence
  Synthetic oligonucleotide
gaaggtgttggaggcactcaaggacctcatcaacgaggcctgctgggatattagctccagcggtgtaaacc

SEQ ID NO: 1793 - DNA, 18 bp, Artificial Sequence
  Synthetic oligonucleotide
ttccacaacttccggcac

SEQ ID NO: 1794 - DNA, 19 bp, Artificial Sequence
  Synthetic oligonucleotide
agactgcagagccagacca

SEQ ID NO: 1795 - DNA, 24 bp, Artificial Sequence
  Synthetic oligonucleotide
tacatcatctgggccacgcagaag

SEQ ID NO: 1796 - DNA, 68 bp, Artificial Sequence
  Synthetic oligonucleotide
ttccacaacttccggcactgcttctgcgtggcccagatgatgtacagcatggtctggctctgcagtct

SEQ ID NO: 1797 - DNA, 20 bp, Artificial Sequence
  Synthetic oligonucleotide
ccagctctccttccagctac

SEQ ID NO: 1798 - DNA, 20 bp, Artificial Sequence
  Synthetic oligonucleotide
gggtggctctcacttagctc

SEQ ID NO: 1799 - DNA, 24 bp, Artificial Sequence
  Synthetic oligonucleotide
atcaatgtccctgtccgagtgctg

SEQ ID NO: 1800 - DNA, 66 bp, Artificial Sequence
  Synthetic oligonucleotide
ccagctctccttccagctacagatcaatgtccctgtccgagtgctggagctaagtgagagccaccc

SEQ ID NO: 1801 - DNA, 25 bp, Artificial Sequence
  Synthetic oligonucleotide
tgtatttcaagacctctgtgcactt

SEQ ID NO: 1802 - DNA, 23 bp, Artificial Sequence
  Synthetic oligonucleotide
ttagcctgaggaattgctgtgtt

SEQ ID NO: 1803 - DNA, 25 bp, Artificial Sequence
  Synthetic oligonucleotide
tttatgaacctgccctgctcccaca

SEQ ID NO: 1804 - DNA, 75 bp, Artificial Sequence
  Synthetic oligonucleotide
tgtatttcaagacctctgtgcacttatttatgaacctgccctgctcccacagaacacagcaattcctcaggctaa

SEQ ID NO: 1805 - DNA, 19 bp, Artificial Sequence
  Synthetic oligonucleotide
ggagaagttccctccccag

SEQ ID NO: 1806 - DNA, 18 bp, Artificial Sequence
  Synthetic oligonucleotide
atctgtgtccaggcccac

SEQ ID NO: 1807 - DNA, 24 bp, Artificial Sequence
  Synthetic oligonucleotide
ctaccttcggcactaccgctgagc

SEQ ID NO: 1808 - DNA, 79 bp, Artificial Sequence
  Synthetic oligonucleotide
ggagaagttccctccccagaagctcatctaccttcggcactaccgctgagccggcgcccgggtgggcctggacacagat

SEQ ID NO: 1809 - DNA, 20 bp, Artificial Sequence
  Synthetic oligonucleotide
attcccatgccctgttttac

SEQ ID NO: 1810 - DNA, 19 bp, Artificial Sequence
  Synthetic oligonucleotide
ctggctggaagcatctcat

SEQ ID NO: 1811 - DNA, 25 bp, Artificial Sequence
  Synthetic oligonucleotide
actgccctctccttctatgacgggt

SEQ ID NO: 1812 - DNA, 71 bp, Artificial Sequence
  Synthetic oligonucleotide
attcccatgccctgttttaccactgccctctccttctatgacgggtacagacatgagatgcttccagccag

SEQ ID NO: 1813 - DNA, 18 bp, Artificial Sequence
  Synthetic oligonucleotide
gtggttttccctcggagc

SEQ ID NO: 1814 - DNA, 19 bp, Artificial Sequence
  Synthetic oligonucleotide
agcaagggaacagcctcat

SEQ ID NO: 1815 - DNA, 24 bp, Artificial Sequence
  Synthetic oligonucleotide
atcttctcagacgtcccgagccag

SEQ ID NO: 1816 - DNA, 71 bp, Artificial Sequence
  Synthetic oligonucleotide
gtggttttccctcggagccccctggctcgggacgtctgagaagatgccggtcatgaggctgttcccttgct

SEQ ID NO: 1817 - DNA, 24 bp, Artificial Sequence
  Synthetic oligonucleotide
agagccagttgctgtagaactcaa

SEQ ID NO: 1818 - DNA, 21 bp, Artificial Sequence
  Synthetic oligonucleotide
ctgggcctacacagtccttca

SEQ ID NO: 1819 - DNA, 27 bp, Artificial Sequence
  Synthetic oligonucleotide
tctctgctgggcaaggatgttctgttc

SEQ ID NO: 1820 - DNA, 74 bp, Artificial Sequence
  Synthetic oligonucleotide
agagccagttgctgtagaactcaaatctctgctgggcaaggatgttctgttcttgaaggactgtgtaggcccag

SEQ ID NO: 1821 - DNA, 20 bp, Artificial Sequence
  Synthetic oligonucleotide
gataaaggagccgcgtgtca

SEQ ID NO: 1822 - DNA, 20 bp, Artificial Sequence
  Synthetic oligonucleotide
tcacaagtccggcacttgag

SEQ ID NO: 1823 - DNA, 21 bp, Artificial Sequence
  Synthetic oligonucleotide
taaattgccgtcgcagccgca

SEQ ID NO: 1824 - DNA, 66 bp, Artificial Sequence
  Synthetic oligonucleotide
gataaaggagccgcgtgtcactaaattgccgtcgcagccgcagccactcaagtgccggacttgtga

SEQ ID NO: 1825 - DNA, 20 bp, Artificial Sequence
  Synthetic oligonucleotide
gatatggctgatgctgctcc

SEQ ID NO: 1826 - DNA, 20 bp, Artificial Sequence
  Synthetic oligonucleotide
ggtttgggtgttcttgtgga

SEQ ID NO: 1827 - DNA, 24 bp, Artificial Sequence
  Synthetic oligonucleotide
acaatctggcaatgcacagttccc

SEQ ID NO: 1828 - DNA, 66 bp, Artificial Sequence
  Synthetic oligonucleotide
gatatggctgatgctgctcctgggaactgtgcattgccagattgtttccacaagaacacccaaacc

SEQ ID NO: 1829 - DNA, 21 bp, Artificial Sequence
  Synthetic oligonucleotide
ataccaatcaccgcacaaacc

SEQ ID NO: 1830 - DNA, 23 bp, Artificial Sequence
  Synthetic oligonucleotide
cacactagcattttctccgcata

SEQ ID NO: 1831 - DNA, 30 bp, Artificial Sequence
  Synthetic oligonucleotide
tgtgctgtgactggacttaacaaatagcct

SEQ ID NO: 1832 - DNA, 83 bp, Artificial Sequence
  Synthetic oligonucleotide
ataccaatcaccgcacaaacccaggctatttgttaagtccagtcacagcacaaagaaacatatgcggagaaaatgctagtgtg

SEQ ID NO: 1833 - DNA, 20 bp, Artificial Sequence
  Synthetic oligonucleotide
gtgattgaagagcatgccaa

SEQ ID NO: 1834 - DNA, 18 bp, Artificial Sequence
  Synthetic oligonucleotide
gtcctgcgtgggaatagc

SEQ ID NO: 1835 - DNA, 24 bp, Artificial Sequence
  Synthetic oligonucleotide
tcctgcttctcgggatacagacca

SEQ ID NO: 1836 - DNA, 67 bp, Artificial Sequence
  Synthetic oligonucleotide
gtgattgaagagcatgccaattggtctgtatcccgagaagcaggatttagctattcccacgcaggac

SEQ ID NO: 1837 - DNA, 22 bp, Artificial Sequence
  Synthetic oligonucleotide
ggagaactcaatgtccatctcc

SEQ ID NO: 1838 - DNA, 18 bp, Artificial Sequence
  Synthetic oligonucleotide
tgatgcttaggcagggct

SEQ ID NO: 1839 - DNA, 24 bp, Artificial Sequence
  Synthetic oligonucleotide
ttctggacaattactgccacccga

SEQ ID NO: 1840 - DNA, 69 bp, Artificial Sequence
  Synthetic oligonucleotide
ggagaactcaatgtccatctccattcttctggacaattactgccacccgatagccctgcctaagcatca

SEQ ID NO: 1841 - DNA, 20 bp, Artificial Sequence
  Synthetic oligonucleotide
ctgctcaaggacaccgtcta

SEQ ID NO: 1842 - DNA, 18 bp, Artificial Sequence
  Synthetic oligonucleotide
ggatccactctggagggc

SEQ ID NO: 1843 - DNA, 24 bp, Artificial Sequence
  Synthetic oligonucleotide
tacactcgggtcccatcgaagtcc

SEQ ID NO: 1844 - DNA, 67 bp, Artificial Sequence
  Synthetic oligonucleotide
ctgctcaaggacaccgtctacacggacttcgatgggacccgagtgtatagccctccagagtggatcc

SEQ ID NO: 1845 - DNA, 20 bp, Artificial Sequence
  Synthetic oligonucleotide
cctggctgtggtttatcctt

SEQ ID NO: 1846 - DNA, 20 bp, Artificial Sequence
  Synthetic oligonucleotide
tgacccatgctgatgatttc

SEQ ID NO: 1847 - DNA, 26 bp, Artificial Sequence
  Synthetic oligonucleotide
tggcaatacataaatcctgttgccca

SEQ ID NO: 1848 - DNA, 74 bp, Artificial Sequence
  Synthetic oligonucleotide
cctggctgtggtttatccttttgactggcaatacataaatcctgttgcccatatgaaatcatcagcatgggtca

SEQ ID NO: 1849 - DNA, 19 bp, Artificial Sequence
  Synthetic oligonucleotide
gtggatgtgccctgaagga

SEQ ID NO: 1850 - DNA, 20 bp, Artificial Sequence
  Synthetic oligonucleotide
ctgcggatccagggtaagaa

SEQ ID NO: 1851 - DNA, 28 bp, Artificial Sequence
  Synthetic oligonucleotide
aagccaggcgtctacacgagagtctcac

SEQ ID NO: 1852 - DNA, 70 bp, Artificial Sequence
  Synthetic oligonucleotide
gtggatgtgccctgaaggacaagccaggcgtctacacgagagtctcacacttcttaccctggatccgcag

SEQ ID NO: 1853 - DNA, 20 bp, Artificial Sequence
  Synthetic oligonucleotide
cccatggatgctcctctgaa

SEQ ID NO: 1854 - DNA, 20 bp, Artificial Sequence
  Synthetic oligonucleotide
ccggtggctaccagacattg

SEQ ID NO: 1855 - DNA, 22 bp, Artificial Sequence
  Synthetic oligonucleotide
cattgactgccgaggccccatg

SEQ ID NO: 1856 - DNA, 76 bp, Artificial Sequence
  Synthetic oligonucleotide
cccatggatgctcctctgaagagactttcctcattgactgccgaggccccatgaatcaatgtctggtagccaccgg

SEQ ID NO: 1857 - DNA, 20 bp, Artificial Sequence
  Synthetic oligonucleotide
ggcaaaatttccaagaccat

SEQ ID NO: 1858 - DNA, 20 bp, Artificial Sequence
  Synthetic oligonucleotide
atgtatccatgagcgtgtgg

SEQ ID NO: 1859 - DNA, 20 bp, Artificial Sequence
  Synthetic oligonucleotide
tgccaggcctgggactctca

SEQ ID NO: 1860 - DNA, 77 bp, Artificial Sequence
  Synthetic oligonucleotide
ggcaaaatttccaagaccatgtctggactggaatgccaggcctgggactctcagagcccacacgctcatggatacat

SEQ ID NO: 1861 - DNA, 26 bp, Artificial Sequence
  Synthetic oligonucleotide
aatgaatacagtattcccaagcacat

SEQ ID NO: 1862 - DNA, 23 bp, Artificial Sequence
  Synthetic oligonucleotide
tgtctgaagcatcttctggatga

SEQ ID NO: 1863 - DNA, 18 bp, Artificial Sequence
  Synthetic oligonucleotide
aaccccgtggccgcctcc

SEQ ID NO: 1864 - DNA, 69 bp, Artificial Sequence
  Synthetic oligonucleotide
aatgaatacagtattcccaagcacatcaaccccgtggccgcctccctcatccagaagatgcttcagaca

SEQ ID NO: 1865 - DNA, 19 bp, Artificial Sequence
  Synthetic oligonucleotide
cagggaggtggttgcaaat

SEQ ID NO: 1866 - DNA, 19 bp, Artificial Sequence
  Synthetic oligonucleotide
tctcccaggatgcatgaag

SEQ ID NO: 1867 - DNA, 24 bp, Artificial Sequence
  Synthetic oligonucleotide
tccagccttttcgtggtgactcaa

SEQ ID NO: 1868 - DNA, 84 bp, Artificial Sequence
  Synthetic oligonucleotide
cagggaggtggttgcaaatttctaaggtacaattgctctattgagtcaccacgaaaaggctggagcttcatgcatcctgggaga

SEQ ID NO: 1869 - DNA, 19 bp, Artificial Sequence
  Synthetic oligonucleotide
cctgatctgcttcagtgcc

SEQ ID NO: 1870 - DNA, 21 bp, Artificial Sequence
  Synthetic oligonucleotide
gcagcaaggatcatctcaatc

SEQ ID NO: 1871 - DNA, 24 bp, Artificial Sequence
  Synthetic oligonucleotide
acaccaggctactcctccctgtcg

SEQ ID NO: 1872 - DNA, 69 bp, Artificial Sequence
  Synthetic oligonucleotide
cctgatctgcttcagtgcctccacaccaggctactcctccctgtcggtgattgagatgatccttgctgc

SEQ ID NO: 1873 - DNA, 20 bp, Artificial Sequence
  Synthetic oligonucleotide
tggagaaggtgaactgcatc

SEQ ID NO: 1874 - DNA, 19 bp, Artificial Sequence
  Synthetic oligonucleotide
cacggcttgggtgtacatt

SEQ ID NO: 1875 - DNA, 21 bp, Artificial Sequence
  Synthetic oligonucleotide
acccgtgcctccagtccacac

SEQ ID NO: 1876 - DNA, 68 bp, Artificial Sequence
  Synthetic oligonucleotide
tggagaaggtgaactgcatctgtgtggactggaggcacgggtcccgggcaatgtacacccaagccgtg

SEQ ID NO: 1877 - DNA, 18 bp, Artificial Sequence
  Synthetic oligonucleotide
gtggcccaattaggcttg

SEQ ID NO: 1878 - DNA, 18 bp, Artificial Sequence
  Synthetic oligonucleotide
tcacaggtgccagcaaag

SEQ ID NO: 1879 - DNA, 24 bp, Artificial Sequence
  Synthetic oligonucleotide
ttctccatctggcctcagagcaga

SEQ ID NO: 1880 - DNA, 67 bp, Artificial Sequence
  Synthetic oligonucleotide
gtggcccaattaggcttggcatctgctctgaggccagatggagaatacactttgctggcacctgtga

SEQ ID NO: 1881 - DNA, 19 bp, Artificial Sequence
  Synthetic oligonucleotide
acaagcaccatcccagtga

SEQ ID NO: 1882 - DNA, 22 bp, Artificial Sequence
  Synthetic oligonucleotide
cacgaagaaaactatgcagcag

SEQ ID NO: 1883 - DNA, 24 bp, Artificial Sequence
  Synthetic oligonucleotide
accagggctccttgagcaaatcct

SEQ ID NO: 1884 - DNA, 77 bp, Artificial Sequence
  Synthetic oligonucleotide
acaagcaccatcccagtgatgttctggcaggatttgctcaaggagccctggtggcctgctgcatagttttcttcgtg

SEQ ID NO: 1885 - DNA, 20 bp, Artificial Sequence
  Synthetic oligonucleotide
cctggagctccgttactctc

SEQ ID NO: 1886 - DNA, 19 bp, Artificial Sequence
  Synthetic oligonucleotide
agccacatagggatccagg

SEQ ID NO: 1887 - DNA, 24 bp, Artificial Sequence
  Synthetic oligonucleotide
cacccactttaccttctggtgccc

SEQ ID NO: 1888 - DNA, 67 bp, Artificial Sequence
  Synthetic oligonucleotide
cctggagctccgttactctcaggcacccactttaccttctggtgcccacctggatccctatgtggct

SEQ ID NO: 1889 - DNA, 20 bp, Artificial Sequence
  Synthetic oligonucleotide
cggcaaggggttgatataga

SEQ ID NO: 1890 - DNA, 19 bp, Artificial Sequence
  Synthetic oligonucleotide
tgcctggcatctctaagca

SEQ ID NO: 1891 - DNA, 24 bp, Artificial Sequence
  Synthetic oligonucleotide
ccgttcttcttcctttcgagctgc

SEQ ID NO: 1892 - DNA, 68 bp, Artificial Sequence
  Synthetic oligonucleotide
cggcaaggggttgatatagaagcagctcgaaaggaagaagaacggatcatgcttagagatgccaggca

SEQ ID NO: 1893 - DNA, 18 bp, Artificial Sequence
  Synthetic oligonucleotide
atactccgagcccacgaa

SEQ ID NO: 1894 - DNA, 18 bp, Artificial Sequence
  Synthetic oligonucleotide
ggaagcctgttgtttggc

SEQ ID NO: 1895 - DNA, 24 bp, Artificial Sequence
  Synthetic oligonucleotide
tacatgcggtaccctgcatcttgg

SEQ ID NO: 1896 - DNA, 70 bp, Artificial Sequence
  Synthetic oligonucleotide
atactccgagcccacgaagcccaagatgcagggtaccgcatgtacaggaaaagccaaacaacaggcttcc

SEQ ID NO: 1897 - DNA, 18 bp, Artificial Sequence
  Synthetic oligonucleotide
atcctcttccctgagccg

SEQ ID NO: 1898 - DNA, 20 bp, Artificial Sequence
  Synthetic oligonucleotide
cccagctgagagggaattta

SEQ ID NO: 1899 - DNA, 24 bp, Artificial Sequence
  Synthetic oligonucleotide
tgacgcatccagggctctagtctg

SEQ ID NO: 1900 - DNA, 67 bp, Artificial Sequence
  Synthetic oligonucleotide
atcctcttccctgagccgctgacgcatccagggctctagtctgcacataaattccctctcagctggg

SEQ ID NO: 1901 - DNA, 19 bp, Artificial Sequence
  Synthetic oligonucleotide
acaaaaccatgactgcgct

SEQ ID NO: 1902 - DNA, 18 bp, Artificial Sequence
  Synthetic oligonucleotide
tgtcatccaggtgagcga

SEQ ID NO: 1903 - DNA, 24 bp, Artificial Sequence
  Synthetic oligonucleotide
aaggccatctccaagaacgtgctc

SEQ ID NO: 1904 - DNA, 66 bp, Artificial Sequence
  Synthetic oligonucleotide
acaaaaccatgactgcgctggccaaggccatctccaagaacgtgctcttcgctcacctggatgaca

SEQ ID NO: 1905 - DNA, 20 bp, Artificial Sequence
  Synthetic oligonucleotide
tgataatcgtgggagtttcg

SEQ ID NO: 1906 - DNA, 20 bp, Artificial Sequence
  Synthetic oligonucleotide
gcaccaggagaggtagcagt

SEQ ID NO: 1907 - DNA, 29 bp, Artificial Sequence
  Synthetic oligonucleotide
cgaactggccttaatgtacaatacaccca

SEQ ID NO: 1908 - DNA, 84 bp, Artificial Sequence
  Synthetic oligonucleotide
tgataatcgtgggagtttcggcgaactggccttaatgtacaatacacccagagcagctacaatcactgctacctctcctggtgc

SEQ ID NO: 1909 - DNA, 21 bp, Artificial Sequence
  Synthetic oligonucleotide
caagcaatgcgtcatcaatgt

SEQ ID NO: 1910 - DNA, 20 bp, Artificial Sequence
  Synthetic oligonucleotide
gtaaatccgccccctcttct

SEQ ID NO: 1911 - DNA, 25 bp, Artificial Sequence
  Synthetic oligonucleotide
cagcctctgcggaatggatcacact

SEQ ID NO: 1912 - DNA, 70 bp, Artificial Sequence
  Synthetic oligonucleotide
caagcaatgcgtcatcaatgtccccagcctctgcggaatggatcacactgagaagagggggcggatttac

SEQ ID NO: 1913 - DNA, 18 bp, Artificial Sequence
  Synthetic oligonucleotide
gacccagctccactcctg

SEQ ID NO: 1914 - DNA, 20 bp, Artificial Sequence
  Synthetic oligonucleotide
cccattcacgtactccatca

SEQ ID NO: 1915 - DNA, 24 bp, Artificial Sequence
  Synthetic oligonucleotide
ccagaccatggaccgcctgtactt

SEQ ID NO: 1916 - DNA, 67 bp, Artificial Sequence
  Synthetic oligonucleotide
gacccagctccactcctgcttccagaccatggaccgcctgtactttgtgatggagtacgtgaatggg

SEQ ID NO: 1917 - DNA, 19 bp, Artificial Sequence
  Synthetic oligonucleotide
ctatgacaggcatgccacc

SEQ ID NO: 1918 - DNA, 20 bp, Artificial Sequence
  Synthetic oligonucleotide
ctccaaccatgaggaagacg

SEQ ID NO: 1919 - DNA, 23 bp, Artificial Sequence
  Synthetic oligonucleotide
acccgaggctgtgtctccaacac

SEQ ID NO: 1920 - DNA, 74 bp, Artificial Sequence
  Synthetic oligonucleotide
ctatgacaggcatgccaccccgaccacccgaggctgtgtctccaacaccggaggcgtcttcctcatggttggag

SEQ ID NO: 1921 - DNA, 22 bp, Artificial Sequence
  Synthetic oligonucleotide
gcagcacaggaatcttcttctt

SEQ ID NO: 1922 - DNA, 22 bp, Artificial Sequence
  Synthetic oligonucleotide
cccacctatccaacctaatctg

SEQ ID NO: 1923 - DNA, 24 bp, Artificial Sequence
  Synthetic oligonucleotide
ctcatcctgacagactgcagctgc

SEQ ID NO: 1924 - DNA, 73 bp, Artificial Sequence
  Synthetic oligonucleotide
gcagcacaggaatcttcttcttggcagctgcagtctgtcaggatgagatatcagattaggttggataggtggg

SEQ ID NO: 1925 - DNA, 19 bp, Artificial Sequence
  Synthetic oligonucleotide
accgtcatcagcaaaggct

SEQ ID NO: 1926 - DNA, 19 bp, Artificial Sequence
  Synthetic oligonucleotide
cgtgatgttcttcttgccc

SEQ ID NO: 1927 - DNA, 24 bp, Artificial Sequence
  Synthetic oligonucleotide
cctgtgagtcatccacgcagttca

SEQ ID NO: 1928 - DNA, 78 bp, Artificial Sequence
  Synthetic oligonucleotide
accgtcatcagcaaaggctgcagcttgaactgcgtggatgactcacaggactactacgtgggcaagaagaacatcacg

SEQ ID NO: 1929 - DNA, 22 bp, Artificial Sequence
  Synthetic oligonucleotide
ggaggagctctacacgaagaag

SEQ ID NO: 1930 - DNA, 19 bp, Artificial Sequence
  Synthetic oligonucleotide
cggatcctgcacaaaatca

SEQ ID NO: 1931 - DNA, 24 bp, Artificial Sequence
  Synthetic oligonucleotide
cctgaagtgtcagctgatgccaca

SEQ ID NO: 1932 - DNA, 70 bp, Artificial Sequence
  Synthetic oligonucleotide
ggaggagctctacacgaagaagttgtggcatcagctgacacttcaggtgcttgattttgtgcaggatccg

SEQ ID NO: 1933 - DNA, 19 bp, Artificial Sequence
  Synthetic oligonucleotide
ccacgacaaagccgactac

SEQ ID NO: 1934 - DNA, 19 bp, Artificial Sequence
  Synthetic oligonucleotide
tactcgatgggctctgctg

SEQ ID NO: 1935 - DNA, 24 bp, Artificial Sequence
  Synthetic oligonucleotide
cctgaaacaaggctgagaatcccg

SEQ ID NO: 1936 - DNA, 66 bp, Artificial Sequence
  Synthetic oligonucleotide
ccacgacaaagccgactacatgcctgaaacaaggctgagaatcccggcagcagagcccatcgagta

SEQ ID NO: 1937 - DNA, 25 bp, Artificial Sequence
  Synthetic oligonucleotide
tggctaagtgaagatgacaatcatg

SEQ ID NO: 1938 - DNA, 25 bp, Artificial Sequence
  Synthetic oligonucleotide
tgcacatatcattacaccagttcgt

SEQ ID NO: 1939 - DNA, 29 bp, Artificial Sequence
  Synthetic oligonucleotide
cctttccagctttacagtgaattgctgca

SEQ ID NO: 1940 - DNA, 81 bp, Artificial Sequence
  Synthetic oligonucleotide
tggctaagtgaagatgacaatcatgttgcagcaattcactgtaaagctggaaagggacgaactggtgtaatgatatgtgca

SEQ ID NO: 1941 - DNA, 20 bp, Artificial Sequence
  Synthetic oligonucleotide
taactggggcaaccttttct

SEQ ID NO: 1942 - DNA, 20 bp, Artificial Sequence
  Synthetic oligonucleotide
ttgcaggaaaaggtgactgt

SEQ ID NO: 1943 - DNA, 22 bp, Artificial Sequence
  Synthetic oligonucleotide
cctttgccttcctggggctctt

SEQ ID NO: 1944 - DNA, 78 bp, Artificial Sequence
  Synthetic oligonucleotide
taactggggcaaccttttcttcgcctctgcctttgccttcctggggctcttggcgctgacagtcaccttttcctgcaa

SEQ ID NO: 1945 - DNA, 22 bp, Artificial Sequence
  Synthetic oligonucleotide
gaatcattcaccaggcaaattg

SEQ ID NO: 1946 - DNA, 20 bp, Artificial Sequence
  Synthetic oligonucleotide
ctgtactgcgggtggaacat

SEQ ID NO: 1947 - DNA, 22 bp, Artificial Sequence
  Synthetic oligonucleotide
cctaccaccagcaaccctgcca

SEQ ID NO: 1948 - DNA, 66 bp, Artificial Sequence
  Synthetic oligonucleotide
gaatcattcaccaggcaaattgctggcagggttgctggtggtaggaatgttccacccgcagtacag

SEQ ID NO: 1949 - DNA, 24 bp, Artificial Sequence
  Synthetic oligonucleotide
cgaggtacaagctgagatcaagaa

SEQ ID NO: 1950 - DNA, 18 bp, Artificial Sequence
  Synthetic oligonucleotide
gcgtgcctttcgcttgaa

SEQ ID NO: 1951 - DNA, 22 bp, Artificial Sequence
  Synthetic oligonucleotide
ccagtgccagtgtccagcggct

SEQ ID NO: 1952 - DNA, 73 bp, Artificial Sequence
  Synthetic oligonucleotide
cgaggtacaagctgagatcaagaaatcttggagccgctggacactggcactggacttcaagcgaaaggcacgc

SEQ ID NO: 1953 - DNA, 22 bp, Artificial Sequence
  Synthetic oligonucleotide
agtgactgggagtgggctagaa

SEQ ID NO: 1954 - DNA, 21 bp, Artificial Sequence
  Synthetic oligonucleotide
aagcctgttaccgtgaatcga

SEQ ID NO: 1955 - DNA, 24 bp, Artificial Sequence
  Synthetic oligonucleotide
tgacacctccacaacgtcgctgga

SEQ ID NO: 1956 - DNA, 83 bp, Artificial Sequence
  Synthetic oligonucleotide
agtgactgggagtgggctagaaggggaccacctgtctgacacctccacaacgtcgctggagctcgattcacggtaacaggctt

SEQ ID NO: 1957 - DNA, 20 bp, Artificial Sequence
  Synthetic oligonucleotide
gaccggtcgaatgataaggt

SEQ ID NO: 1958 - DNA, 20 bp, Artificial Sequence
  Synthetic oligonucleotide
ctggacatctcgatgacagc

SEQ ID NO: 1959 - DNA, 24 bp, Artificial Sequence
  Synthetic oligonucleotide
accaggcccgtcacattctcgtac

SEQ ID NO: 1960 - DNA, 68 bp, Artificial Sequence
  Synthetic oligonucleotide
gaccggtcgaatgataaggtgtacgagaatgtgacgggcctggtgaaagctgtcatcgagatgtccag

SEQ ID NO: 1961 - DNA, 19 bp, Artificial Sequence
  Synthetic oligonucleotide
caagcccagccgacctaag

SEQ ID NO: 1962 - DNA, 21 bp, Artificial Sequence
  Synthetic oligonucleotide
gaacctggaactgcagctttg

SEQ ID NO: 1963 - DNA, 23 bp, Artificial Sequence
  Synthetic oligonucleotide
ctccgcaaaccaacctcctggct

SEQ ID NO: 1964 - DNA, 74 bp, Artificial Sequence
  Synthetic oligonucleotide
caagcccagccgacctaagtacagaccccctccgcaaaccaacctcctggctccaaagctgcagttccaggttc

SEQ ID NO: 1965 - DNA, 20 bp, Artificial Sequence
  Synthetic oligonucleotide
gtgcaggaaaggttcacaaa

SEQ ID NO: 1966 - DNA, 20 bp, Artificial Sequence
  Synthetic oligonucleotide
gcacacacgatggagtaagg

SEQ ID NO: 1967 - DNA, 24 bp, Artificial Sequence
  Synthetic oligonucleotide
agtgtctgcgtccaatacacgcgt

SEQ ID NO: 1968 - DNA, 79 bp, Artificial Sequence
  Synthetic oligonucleotide
gtgcaggaaaggttcacaaatgtggagtgtctgcgtccaatacacgcgtgtgctcctctccttactccatcgtgtgtgc

SEQ ID NO: 1969 - DNA, 19 bp, Artificial Sequence
  Synthetic oligonucleotide
tcagaggactcacggttcg

SEQ ID NO: 1970 - DNA, 20 bp, Artificial Sequence
  Synthetic oligonucleotide
catacacctccacgctgttg

SEQ ID NO: 1971 - DNA, 24 bp, Artificial Sequence
  Synthetic oligonucleotide
cgcaaggtcccattcttgaagacc

SEQ ID NO: 1972 - DNA, 67 bp, Artificial Sequence
  Synthetic oligonucleotide
tcagaggactcacggttcgaggtcttcaagaatgggaccttgcgcatcaacagcgtggaggtgtatg

SEQ ID NO: 1973 - DNA, 20 bp, Artificial Sequence
  Synthetic oligonucleotide
aatgaggaagtttcggatgg

SEQ ID NO: 1974 - DNA, 20 bp, Artificial Sequence
  Synthetic oligonucleotide
cttcgatcacagccaggtag

SEQ ID NO: 1975 - DNA, 23 bp, Artificial Sequence
  Synthetic oligonucleotide
ctgatccagacagccgaccagct

SEQ ID NO: 1976 - DNA, 74 bp, Artificial Sequence
  Synthetic oligonucleotide
aatgaggaagtttcggatggggctgatccagacagccgaccagctgcgcttctcctacctggctgtgatcgaag

SEQ ID NO: 1977 - DNA, 18 bp, Artificial Sequence
  Synthetic oligonucleotide
tcaaaccctcccagtgct

SEQ ID NO: 1978 - DNA, 18 bp, Artificial Sequence
  Synthetic oligonucleotide
agcagccagttcgtccag

SEQ ID NO: 1979 - DNA, 24 bp, Artificial Sequence
  Synthetic oligonucleotide
ccccatcgttgtacattgcagtgc

SEQ ID NO: 1980 - DNA, 67 bp, Artificial Sequence
  Synthetic oligonucleotide
tcaaaccctcccagtgctggccccatcgttgtacattgcagtgctggtgctggacgaactggctgct

SEQ ID NO: 1981 - DNA, 28 bp, Artificial Sequence
  Synthetic oligonucleotide
ggctactctgatctatgttgataaggaa

SEQ ID NO: 1982 - DNA, 20 bp, Artificial Sequence
  Synthetic oligonucleotide
gcttcagcccatccttagca

SEQ ID NO: 1983 - DNA, 22 bp, Artificial Sequence
  Synthetic oligonucleotide
cacacgggtgcctggttctcca

SEQ ID NO: 1984 - DNA, 74 bp, Artificial Sequence
  Synthetic oligonucleotide
ggctactctgatctatgttgataaggaaaatggagaaccaggcacccgtgtggttgctaaggatgggctgaagc

SEQ ID NO: 1985 - DNA, 20 bp, Artificial Sequence
  Synthetic oligonucleotide
ctttatagaccagcaccggg

SEQ ID NO: 1986 - DNA, 18 bp, Artificial Sequence
  Synthetic oligonucleotide
agcatccagcagccactc

SEQ ID NO: 1987 - DNA, 24 bp, Artificial Sequence
  Synthetic oligonucleotide
acgtttgtgaccctcgcgataagc

SEQ ID NO: 1988 - DNA, 67 bp, Artificial Sequence
  Synthetic oligonucleotide
ctttatagaccagcaccgggctgcgcttatcgcgagggtcacaaacgttgagtggctgctggatgct

SEQ ID NO: 1989 - DNA, 22 bp, Artificial Sequence
  Synthetic oligonucleotide
tgagagattaatgggcattgtg

SEQ ID NO: 1990 - DNA, 20 bp, Artificial Sequence
  Synthetic oligonucleotide
ccggatgctttattcgtagg

SEQ ID NO: 1991 - DNA, 26 bp, Artificial Sequence
  Synthetic oligonucleotide
acaaattgcttctcaccatccccatt

SEQ ID NO: 1992 - DNA, 72 bp, Artificial Sequence
  Synthetic oligonucleotide
tgagagattaatgggcattgtgtacaaattgcttctcaccatccccattagacctacgaataaagcatccgg

SEQ ID NO: 1993 - DNA, 18 bp, Artificial Sequence
  Synthetic oligonucleotide
taaaggctgaggcacgga

SEQ ID NO: 1994 - DNA, 18 bp, Artificial Sequence
  Synthetic oligonucleotide
ctccccagcatctcatgg

SEQ ID NO: 1995 - DNA, 24 bp, Artificial Sequence
  Synthetic oligonucleotide
ccatcagggcagttgctgattcct

SEQ ID NO: 1996 - DNA, 68 bp, Artificial Sequence
  Synthetic oligonucleotide
taaaggctgaggcacggagaagaaaaggaatcagcaactgccctgatgggccatgagatgctggggag

SEQ ID NO: 1997 - DNA, 19 bp, Artificial Sequence
  Synthetic oligonucleotide
ctgaaggaccctacgctcg

SEQ ID NO: 1998 - DNA, 19 bp, Artificial Sequence
  Synthetic oligonucleotide
atgcaaagccagtgtgctc

SEQ ID NO: 1999 - DNA, 24 bp, Artificial Sequence
  Synthetic oligonucleotide
cttctcaaagtgaggtgccaggcc

SEQ ID NO: 2000 - DNA, 67 bp, Artificial Sequence
  Synthetic oligonucleotide
ctgaaggaccctacgctcggtggcctggcacctcactttgagaagagtgagcacactggctttgcat

SEQ ID NO: 2001 - DNA, 23 bp, Artificial Sequence
  Synthetic oligonucleotide
tagggatggtatctgaaacaaca

SEQ ID NO: 2002 - DNA, 18 bp, Artificial Sequence
  Synthetic oligonucleotide
tcgcgtacacctctgctc

SEQ ID NO: 2003 - DNA, 30 bp, Artificial Sequence
  Synthetic oligonucleotide
cacttaaaacgaatctcaagagggtgacca

SEQ ID NO: 2004 - DNA, 84 bp, Artificial Sequence
  Synthetic oligonucleotide
tagggatggtatctgaaacaacaatggtcaccctcttgagattcgttttaagtgtaattccataatgagcagaggtgtacgcga

SEQ ID NO: 2005 - DNA, 20 bp, Artificial Sequence
  Synthetic oligonucleotide
agactactcgggtcgaggtg

SEQ ID NO: 2006 - DNA, 18 bp, Artificial Sequence
  Synthetic oligonucleotide
agcatccgcagaaacctg

SEQ ID NO: 2007 - DNA, 24 bp, Artificial Sequence
  Synthetic oligonucleotide
ctttcagccaggcagatgcacttg

SEQ ID NO: 2008 - DNA, 66 bp, Artificial Sequence
  Synthetic oligonucleotide
agactactcgggtcgaggtgagctttcagccaggcagatgcacttggccaggtttctgcggatgct

SEQ ID NO: 2009 - DNA, 19 bp, Artificial Sequence
  Synthetic oligonucleotide
gccatcttcaccatcaagg

SEQ ID NO: 2010 - DNA, 19 bp, Artificial Sequence
  Synthetic oligonucleotide
cggtgtctgagagtgtggc

SEQ ID NO: 2011 - DNA, 24 bp, Artificial Sequence
  Synthetic oligonucleotide
ctttgctggacggccactttgtct

SEQ ID NO: 2012 - DNA, 67 bp, Artificial Sequence
  Synthetic oligonucleotide
gccatcttcaccatcaaggactctttgctggacggccactttgtcttggccacactctcagacaccg

SEQ ID NO: 2013 - DNA, 20 bp, Artificial Sequence
  Synthetic oligonucleotide
cgtcgtatgcgagagtctgt

SEQ ID NO: 2014 - DNA, 20 bp, Artificial Sequence
  Synthetic oligonucleotide
tgaaggcgtgaggtgtagaa

SEQ ID NO: 2015 - DNA, 26 bp, Artificial Sequence
  Synthetic oligonucleotide
tccaggatgcctgttagttctcagca

SEQ ID NO: 2016 - DNA, 73 bp, Artificial Sequence
  Synthetic oligonucleotide
cgtcgtatgcgagagtctgtttccaggatgcctgttagttctcagcacagatattctacacctcacgccttca

SEQ ID NO: 2017 - DNA, 20 bp, Artificial Sequence
  Synthetic oligonucleotide
attaggggactttggctcct

SEQ ID NO: 2018 - DNA, 20 bp, Artificial Sequence
  Synthetic oligonucleotide
gggtggagatgtattccgtg

SEQ ID NO: 2019 - DNA, 24 bp, Artificial Sequence
  Synthetic oligonucleotide
ccggagtgtctattccaagcagcc

SEQ ID NO: 2020 - DNA, 68 bp, Artificial Sequence
  Synthetic oligonucleotide
attaggggactttggctcctgccggagtgtctattccaagcagccgtacacggaatacatctccaccc

SEQ ID NO: 2021 - DNA, 20 bp, Artificial Sequence
  Synthetic oligonucleotide
tggtcctgaatgtagcgtgt

SEQ ID NO: 2022 - DNA, 20 bp, Artificial Sequence
  Synthetic oligonucleotide
ccccatttcacctcttcaat

SEQ ID NO: 2023 - DNA, 28 bp, Artificial Sequence
  Synthetic oligonucleotide
ttgtgtttcttgggcagtctttcttgaa

SEQ ID NO: 2024 - DNA, 72 bp, Artificial Sequence
  Synthetic oligonucleotide
tggtcctgaatgtagcgtgtaagcttgtgtttcttgggcagtctttcttgaaattgaagaggtgaaatgggg

SEQ ID NO: 2025 - DNA, 26 bp, Artificial Sequence
  Synthetic oligonucleotide
ggtgtcagatataaatgtgcaaatgc

SEQ ID NO: 2026 - DNA, 24 bp, Artificial Sequence
  Synthetic oligonucleotide
ttcgatattgccagcagctataaa

SEQ ID NO: 2027 - DNA, 28 bp, Artificial Sequence
  Synthetic oligonucleotide
tgctgtcctgtcggtctcagtacgttca

SEQ ID NO: 2028 - DNA, 84 bp, Artificial Sequence
  Synthetic oligonucleotide
ggtgtcagatataaatgtgcaaatgccttcttgctgtcctgtcggtctcagtacgttcactttatagctgctggcaatatcgaa

SEQ ID NO: 2029 - DNA, 22 bp, Artificial Sequence
  Synthetic oligonucleotide
tgacagcgtgagaggtactagg

SEQ ID NO: 2030 - DNA, 22 bp, Artificial Sequence
  Synthetic oligonucleotide
ctgagccaagaacgactagctt

SEQ ID NO: 2031 - DNA, 24 bp, Artificial Sequence
  Synthetic oligonucleotide
cacgcatgatgcaagcttgtcaaa

SEQ ID NO: 2032 - DNA, 74 bp, Artificial Sequence
  Synthetic oligonucleotide
tgacagcgtgagaggtactaggttttgacaagcttgcatcatgcgtgagtataagctagtcgttcttggctcag

SEQ ID NO: 2033 - DNA, 20 bp, Artificial Sequence
  Synthetic oligonucleotide
atgaacccttgaccccaagt

SEQ ID NO: 2034 - DNA, 20 bp, Artificial Sequence
  Synthetic oligonucleotide
gagctgggtgagatgctagg

SEQ ID NO: 2035 - DNA, 24 bp, Artificial Sequence
  Synthetic oligonucleotide
tgtgctctgctgtgttcccacttg

SEQ ID NO: 2036 - DNA, 67 bp, Artificial Sequence
  Synthetic oligonucleotide
atgaacccttgaccccaagttcaagtgggaacacagcagagcacagtcctagcatctcacccagctc

SEQ ID NO: 2037 - DNA, 19 bp, Artificial Sequence
  Synthetic oligonucleotide
agggcacgtgaagtcattg

SEQ ID NO: 2038 - DNA, 19 bp, Artificial Sequence
  Synthetic oligonucleotide
aaagagtgcaaacttgcgg

SEQ ID NO: 2039 - DNA, 24 bp, Artificial Sequence
  Synthetic oligonucleotide
caccaccaagaactttcgcagcag

SEQ ID NO: 2040 - DNA, 75 bp, Artificial Sequence
  Synthetic oligonucleotide
agggcacgtgaagtcattgaggccctgctgcgaaagttcttggtggtggatgacccccgcaagtttgcactcttt

SEQ ID NO: 2041 - DNA, 20 bp, Artificial Sequence
  Synthetic oligonucleotide
cgaagcccttacaagtttcc

SEQ ID NO: 2042 - DNA, 20 bp, Artificial Sequence
  Synthetic oligonucleotide
ggactcttcaggggtgaaat

SEQ ID NO: 2043 - DNA, 24 bp, Artificial Sequence
  Synthetic oligonucleotide
cccttacggattcctggagggaac

SEQ ID NO: 2044 - DNA, 77 bp, Artificial Sequence
  Synthetic oligonucleotide
cgaagcccttacaagtttcctagttcacccttacggattcctggagggaacatctatatttcacccctgaagagtcc

SEQ ID NO: 2045 - DNA, 18 bp, Artificial Sequence
  Synthetic oligonucleotide
gtcgccgagtgtgcttct

SEQ ID NO: 2046 - DNA, 18 bp, Artificial Sequence
  Synthetic oligonucleotide
gtgggatgatgggtttgc

SEQ ID NO: 2047 - DNA, 24 bp, Artificial Sequence
  Synthetic oligonucleotide
tcaagtgtccttcgctcttggcag

SEQ ID NO: 2048 - DNA, 67 bp, Artificial Sequence
  Synthetic oligonucleotide
gtcgccgagtgtgcttctgtcaagtgtccttcgctcttggcagctggatgcaaacccatcatcccac

SEQ ID NO: 2049 - DNA, 19 bp, Artificial Sequence
  Synthetic oligonucleotide
tgctaactcctgcacagcc

SEQ ID NO: 2050 - DNA, 20 bp, Artificial Sequence
  Synthetic oligonucleotide
tgctaggtttcccctctgaa

SEQ ID NO: 2051 - DNA, 25 bp, Artificial Sequence
  Synthetic oligonucleotide
tcctcttcctttctgctagcctggc

SEQ ID NO: 2052 - DNA, 83 bp, Artificial Sequence
  Synthetic oligonucleotide
tgctaactcctgcacagccccgtcctcttcctttctgctagcctggctaaatctgctcattatttcagaggggaaacctagca

SEQ ID NO: 2053 - DNA, 19 bp, Artificial Sequence
  Synthetic oligonucleotide
ctgccgggatggcttctat

SEQ ID NO: 2054 - DNA, 22 bp, Artificial Sequence
  Synthetic oligonucleotide
ccaggttctggaaactgtggat

SEQ ID NO: 2055 - DNA, 21 bp, Artificial Sequence
  Synthetic oligonucleotide
ctgagctctgcccggaccgct

SEQ ID NO: 2056 - DNA, 68 bp, Artificial Sequence
  Synthetic oligonucleotide
ctgccgggatggcttctatgaggctgagctctgcccggaccgctgcatccacagtttccagaacctgg

SEQ ID NO: 2057 - DNA, 19 bp, Artificial Sequence
  Synthetic oligonucleotide
tcctctccaagttcgagcc

SEQ ID NO: 2058 - DNA, 18 bp, Artificial Sequence
  Synthetic oligonucleotide
caggccctggtacagcac

SEQ ID NO: 2059 - DNA, 24 bp, Artificial Sequence
  Synthetic oligonucleotide
tccaatggaccaagcactgtgaca

SEQ ID NO: 2060 - DNA, 68 bp, Artificial Sequence
  Synthetic oligonucleotide
tcctctccaagttcgagcccgtgctccaatggaccaagcactgtgacaacgtgctgtaccagggcctg

SEQ ID NO: 2061 - DNA, 19 bp, Artificial Sequence
  Synthetic oligonucleotide
agacatccacgacagcgat

SEQ ID NO: 2062 - DNA, 19 bp, Artificial Sequence
  Synthetic oligonucleotide
ccatttggctgtgctcttg

SEQ ID NO: 2063 - DNA, 23 bp, Artificial Sequence
  Synthetic oligonucleotide
agttccagcagcagccaccagag

SEQ ID NO: 2064 - DNA, 67 bp, Artificial Sequence
  Synthetic oligonucleotide
agacatccacgacagcgatggcagttccagcagcagccaccagagcctcaagagcacagccaaatgg

SEQ ID NO: 2065 - DNA, 19 bp, Artificial Sequence
  Synthetic oligonucleotide
caggctgcagagagcattt

SEQ ID NO: 2066 - DNA, 20 bp, Artificial Sequence
  Synthetic oligonucleotide
tttgcttgtgcttctgcttg

SEQ ID NO: 2067 - DNA, 24 bp, Artificial Sequence
  Synthetic oligonucleotide
tgaaaatgaactcccacttccggg

SEQ ID NO: 2068 - DNA, 66 bp, Artificial Sequence
  Synthetic oligonucleotide
caggctgcagagagcatttgcccggaagtgggagttcattttcatgcaagcagaagcacaagcaaa

SEQ ID NO: 2069 - DNA, 18 bp, Artificial Sequence
  Synthetic oligonucleotide
tggcatagctctggggtg

SEQ ID NO: 2070 - DNA, 18 bp, Artificial Sequence
  Synthetic oligonucleotide
tgccacagctgcatgaac

SEQ ID NO: 2071 - DNA, 24 bp, Artificial Sequence
  Synthetic oligonucleotide
aaatgggctcaaccagaaaagccc

SEQ ID NO: 2072 - DNA, 75 bp, Artificial Sequence
  Synthetic oligonucleotide
tggcatagctctggggtgggcagttttttgaaaatgggctcaaccagaaaagcccaagttcatgcagctgtggca

SEQ ID NO: 2073 - DNA, 21 bp, Artificial Sequence
  Synthetic oligonucleotide
aagcatgaacaggacttgacc

SEQ ID NO: 2074 - DNA, 18 bp, Artificial Sequence
  Synthetic oligonucleotide
cctccccaagtcagttgc

SEQ ID NO: 2075 - DNA, 24 bp, Artificial Sequence
  Synthetic oligonucleotide
ctttccaacccctggggaagacat

SEQ ID NO: 2076 - DNA, 67 bp, Artificial Sequence
  Synthetic oligonucleotide
aagcatgaacaggacttgaccatctttccaacccctggggaagacatttgcaactgacttggggagg

SEQ ID NO: 2077 - DNA, 18 bp, Artificial Sequence
  Synthetic oligonucleotide
cccgttcggtctgaggaa

SEQ ID NO: 2078 - DNA, 22 bp, Artificial Sequence
  Synthetic oligonucleotide
gagcactcaaggtagccaaagg

SEQ ID NO: 2079 - DNA, 19 bp, Artificial Sequence
  Synthetic oligonucleotide
tccggttcgccatgtcccg

SEQ ID NO: 2080 - DNA, 68 bp, Artificial Sequence
  Synthetic oligonucleotide
cccgttcggtctgaggaaggccgggacatggcgaaccggatcagtgcctttggctaccttgagtgctc

SEQ ID NO: 2081 - DNA, 19 bp, Artificial Sequence
  Synthetic oligonucleotide
agctgaaggcagccctatc

SEQ ID NO: 2082 - DNA, 21 bp, Artificial Sequence
  Synthetic oligonucleotide
ttggaatcctttaatgcaggt

SEQ ID NO: 2083 - DNA, 26 bp, Artificial Sequence
  Synthetic oligonucleotide
tgagaggcaaccatcattaccagagc

SEQ ID NO: 2084 - DNA, 79 bp, Artificial Sequence
  Synthetic oligonucleotide
agctgaaggcagccctatctgagaggcaaccatcattaccagagctacagcagtatgtacctgcattaaaggattccaa

SEQ ID NO: 2085 - DNA, 19 bp, Artificial Sequence
  Synthetic oligonucleotide
tcggaattggacttgggag

SEQ ID NO: 2086 - DNA, 20 bp, Artificial Sequence
  Synthetic oligonucleotide
ctggttactcccctccaaca

SEQ ID NO: 2087 - DNA, 24 bp, Artificial Sequence
  Synthetic oligonucleotide
ttttaagcctgactcctcaccgcg

SEQ ID NO: 2088 - DNA, 66 bp, Artificial Sequence
  Synthetic oligonucleotide
tcggaattggacttgggaggcgcggtgaggagtcaggcttaaaacttgttggaggggagtaaccag

SEQ ID NO: 2089 - DNA, 18 bp, Artificial Sequence
  Synthetic oligonucleotide
tgacaggggaagtgggtc

SEQ ID NO: 2090 - DNA, 20 bp, Artificial Sequence
  Synthetic oligonucleotide
ggaagacagctttggcaaga

SEQ ID NO: 2091 - DNA, 24 bp, Artificial Sequence
  Synthetic oligonucleotide
ccaggtcagcccttctcttccctt

SEQ ID NO: 2092 - DNA, 68 bp, Artificial Sequence
  Synthetic oligonucleotide
tgacaggggaagtgggtccccaggtcagcccttctcttccctttgggctcttgccaaagctgtcttcc

SEQ ID NO: 2093 - DNA, 18 bp, Artificial Sequence
  Synthetic oligonucleotide
ctacaaggcccagccaac

SEQ ID NO: 2094 - DNA, 22 bp, Artificial Sequence
  Synthetic oligonucleotide
caccagtggctttacatttcag

SEQ ID NO: 2095 - DNA, 24 bp, Artificial Sequence
  Synthetic oligonucleotide
ctgtaccatccactgccagcgttt

SEQ ID NO: 2096 - DNA, 70 bp, Artificial Sequence
  Synthetic oligonucleotide
ctacaaggcccagccaaccaaacgctggcagtggatggtacagcgttactgaaatgtaaagccactggtg

SEQ ID NO: 2097 - DNA, 20 bp, Artificial Sequence
  Synthetic oligonucleotide
gggctactggcagctacatt

SEQ ID NO: 2098 - DNA, 20 bp, Artificial Sequence
  Synthetic oligonucleotide
ctctcagcatcggtacaagg

SEQ ID NO: 2099 - DNA, 25 bp, Artificial Sequence
  Synthetic oligonucleotide
cattggaattgccattagtcccagc

SEQ ID NO: 2100 - DNA, 66 bp, Artificial Sequence
  Synthetic oligonucleotide
gggctactggcagctacattgctgggactaatggcaattccaatggccttgtaccgatgctgagag

SEQ ID NO: 2101 - DNA, 20 bp, Artificial Sequence
  Synthetic oligonucleotide
cagcgggattaaacagtcct

SEQ ID NO: 2102 - DNA, 20 bp, Artificial Sequence
  Synthetic oligonucleotide
atctgcgttgaagcagtgag

SEQ ID NO: 2103 - DNA, 25 bp, Artificial Sequence
  Synthetic oligonucleotide
ccagcacagccagttaaaagatgca

SEQ ID NO: 2104 - DNA, 71 bp, Artificial Sequence
  Synthetic oligonucleotide
cagcgggattaaacagtcctttaaccagcacagccagttaaaagatgcagcctcactgcttcaacgcagat

SEQ ID NO: 2105 - DNA, 21 bp, Artificial Sequence
  Synthetic oligonucleotide
agacaaggatgccgtggataa

SEQ ID NO: 2106 - DNA, 20 bp, Artificial Sequence
  Synthetic oligonucleotide
gaagtccacctgggcatctc

SEQ ID NO: 2107 - DNA, 23 bp, Artificial Sequence
  Synthetic oligonucleotide
ttgctcaaggacctggacgccaa

SEQ ID NO: 2108 - DNA, 67 bp, Artificial Sequence
  Synthetic oligonucleotide
agacaaggatgccgtggataaattgctcaaggacctggacgccaatggagatgcccaggtggacttc

SEQ ID NO: 2109 - DNA, 20 bp, Artificial Sequence
  Synthetic oligonucleotide
ccttttaccactgcctggtt

SEQ ID NO: 2110 - DNA, 19 bp, Artificial Sequence
  Synthetic oligonucleotide
acaatgctgtgtccttccg

SEQ ID NO: 2111 - DNA, 24 bp, Artificial Sequence
  Synthetic oligonucleotide
tccagtgctctttcggcacttctg

SEQ ID NO: 2112 - DNA, 67 bp, Artificial Sequence
  Synthetic oligonucleotide
ccttttaccactgcctggttgcagaagtgccgaaagagcactggactccggaaggacacagcattgt

SEQ ID NO: 2113 - DNA, 21 bp, Artificial Sequence
  Synthetic oligonucleotide
tgacaatcagcacacctgcat

SEQ ID NO: 2114 - DNA, 23 bp, Artificial Sequence
  Synthetic oligonucleotide
tgtgactacagccgtgatcctta

SEQ ID NO: 2115 - DNA, 20 bp, Artificial Sequence
  Synthetic oligonucleotide
caggccctcttccgagcggt

SEQ ID NO: 2116 - DNA, 77 bp, Artificial Sequence
  Synthetic oligonucleotide
tgacaatcagcacacctgcattcaccgctcggaagagggcctgagctgcatgaataaggatcacggctgtagtcaca

SEQ ID NO: 2117 - DNA, 20 bp, Artificial Sequence
  Synthetic oligonucleotide
gaaattgacgaggggtgtct

SEQ ID NO: 2118 - DNA, 20 bp, Artificial Sequence
  Synthetic oligonucleotide
aggagctaacggagaacctg

SEQ ID NO: 2119 - DNA, 22 bp, Artificial Sequence
  Synthetic oligonucleotide
ctctgagcgcctccatccaagg

SEQ ID NO: 2120 - DNA, 76 bp, Artificial Sequence
  Synthetic oligonucleotide
gaaattgacgaggggtgtcttgggcagagctggctctgagcgcctccatccaaggccaggttctccgttagctcct

SEQ ID NO: 2121 - DNA, 20 bp, Artificial Sequence
  Synthetic oligonucleotide
ggattgaagtggctggaaag

SEQ ID NO: 2122 - DNA, 19 bp, Artificial Sequence
  Synthetic oligonucleotide
accagccacagtaccctca

SEQ ID NO: 2123 - DNA, 24 bp, Artificial Sequence
  Synthetic oligonucleotide
aactccatctccttccccaggcat

SEQ ID NO: 2124 - DNA, 68 bp, Artificial Sequence
  Synthetic oligonucleotide
ggattgaagtggctggaaagagtgatgcctggggaaggagatggagttatgagggtactgtggctggt

SEQ ID NO: 2125 - DNA, 18 bp, Artificial Sequence
  Synthetic oligonucleotide
cttccctcgggtctcagg

SEQ ID NO: 2126 - DNA, 20 bp, Artificial Sequence
  Synthetic oligonucleotide
ttccctcctggtaaaggtca

SEQ ID NO: 2127 - DNA, 24 bp, Artificial Sequence
  Synthetic oligonucleotide
ttacatcctccctctccccgcaat

SEQ ID NO: 2128 - DNA, 66 bp, Artificial Sequence
  Synthetic oligonucleotide
cttccctcgggtctcaggcatttacatcctccctctccccgcaatctgacctttaccaggagggaa

SEQ ID NO: 2129 - DNA, 19 bp, Artificial Sequence
  Synthetic oligonucleotide
agggttcccatgtgaccag

SEQ ID NO: 2130 - DNA, 18 bp, Artificial Sequence
  Synthetic oligonucleotide
gcaggcatgctgtggaat

SEQ ID NO: 2131 - DNA, 23 bp, Artificial Sequence
  Synthetic oligonucleotide
cgggcttctacatcctgcagtgg

SEQ ID NO: 2132 - DNA, 67 bp, Artificial Sequence
  Synthetic oligonucleotide
agggttcccatgtgaccaggtggccgggcttctacatcctgcagtggaaattccacagcatgcctgc

SEQ ID NO: 2133 - DNA, 22 bp, Artificial Sequence
  Synthetic oligonucleotide
cgtgtgcattagatcagacagg

SEQ ID NO: 2134 - DNA, 22 bp, Artificial Sequence
  Synthetic oligonucleotide
cccattaccatgtatcctccag

SEQ ID NO: 2135 - DNA, 24 bp, Artificial Sequence
  Synthetic oligonucleotide
tcctggagatgaaatgctgtccca

SEQ ID NO: 2136 - DNA, 76 bp, Artificial Sequence
  Synthetic oligonucleotide
cgtgtgcattagatcagacaggtctcctggagatgaaatgctgtcccaaccttactggaggatacatggtaatggg

SEQ ID NO: 2137 - DNA, 19 bp, Artificial Sequence
  Synthetic oligonucleotide
ttggaatgcagtccgaagt

SEQ ID NO: 2138 - DNA, 20 bp, Artificial Sequence
  Synthetic oligonucleotide
ctcttcatttcgcctctgga

SEQ ID NO: 2139 - DNA, 24 bp, Artificial Sequence
  Synthetic oligonucleotide
ttgccaatagaccagcgctctctg

SEQ ID NO: 2140 - DNA, 66 bp, Artificial Sequence
  Synthetic oligonucleotide
ttggaatgcagtccgaagtcgcagagagcgctggtctattggcaattccagaggcgaaatgaagag

SEQ ID NO: 2141 - DNA, 20 bp, Artificial Sequence
  Synthetic oligonucleotide
cagtgaccacgagtaccagg

SEQ ID NO: 2142 - DNA, 20 bp, Artificial Sequence
  Synthetic oligonucleotide
cttcgatggtaccccacttg

SEQ ID NO: 2143 - DNA, 24 bp, Artificial Sequence
  Synthetic oligonucleotide
ttgccaatagaccagcgctctctg

SEQ ID NO: 2144 - DNA, 71 bp, Artificial Sequence
  Synthetic oligonucleotide
cagtgaccacgagtaccaggtcaacggcaagaggatccttgggaggaagaccaagtggggtaccatcgaag

SEQ ID NO: 2145 - DNA, 19 bp, Artificial Sequence
  Synthetic oligonucleotide
gtgtggccctgtctgctta

SEQ ID NO: 2146 - DNA, 21 bp, Artificial Sequence
  Synthetic oligonucleotide
ccctgtgcatgtgagagctac

SEQ ID NO: 2147 - DNA, 24 bp, Artificial Sequence
  Synthetic oligonucleotide
agggaatcgctgtcaccttccaag

SEQ ID NO: 2148 - DNA, 68 bp, Artificial Sequence
  Synthetic oligonucleotide
gtgtggccctgtctgcttatccttggaaggtgacagcgattccctgtgtagctctcacatgcacaggg

SEQ ID NO: 2149 - DNA, 23 bp, Artificial Sequence
  Synthetic oligonucleotide
cagatggccactttgagaacatt

SEQ ID NO: 2150 - DNA, 22 bp, Artificial Sequence
  Synthetic oligonucleotide
ggcagcattaaccacaaggatt

SEQ ID NO: 2151 - DNA, 28 bp, Artificial Sequence
  Synthetic oligonucleotide
agctgacaacagtgtgaacgaccagacc

SEQ ID NO: 2152 - DNA, 77 bp, Artificial Sequence
  Synthetic oligonucleotide
cagatggccactttgagaacattttagctgacaacagtgtgaacgaccagaccaaaatccttgtggttaatgctgcc

SEQ ID NO: 2153 - DNA, 20 bp, Artificial Sequence
  Synthetic oligonucleotide
gaccctggttttgggtatga

SEQ ID NO: 2154 - DNA, 18 bp, Artificial Sequence
  Synthetic oligonucleotide
gagctcggaatgttggca

SEQ ID NO: 2155 - DNA, 24 bp, Artificial Sequence
  Synthetic oligonucleotide
tgctcttctcctcgtctggcaaag

SEQ ID NO: 2156 - DNA, 67 bp, Artificial Sequence
  Synthetic oligonucleotide
gaccctggttttgggtatgaagactttgccagacgaggagaagagcatttgccaacattccgagctc

SEQ ID NO: 2157 - DNA, 18 bp, Artificial Sequence
  Synthetic oligonucleotide
tacaggatgaggctgggc

SEQ ID NO: 2158 - DNA, 18 bp, Artificial Sequence
  Synthetic oligonucleotide
gttgttagggcaaggggc

SEQ ID NO: 2159 - DNA, 24 bp, Artificial Sequence
  Synthetic oligonucleotide
cctgggacagcctatgtaaggcca

SEQ ID NO: 2160 - DNA, 67 bp, Artificial Sequence
  Synthetic oligonucleotide
tacaggatgaggctgggcattgcctgggacagcctatgtaaggccatgtgccccttgccctaacaac

SEQ ID NO: 2161 - DNA, 20 bp, Artificial Sequence
  Synthetic oligonucleotide
ccatcacaacagccttgaac

SEQ ID NO: 2162 - DNA, 20 bp, Artificial Sequence
  Synthetic oligonucleotide
cactggggtgctgatctcta

SEQ ID NO: 2163 - DNA, 24 bp, Artificial Sequence
  Synthetic oligonucleotide
aaccggatggtccattctccttca

SEQ ID NO: 2164 - DNA, 83 bp, Artificial Sequence
  Synthetic oligonucleotide
ccatcacaacagccttgaacactctcaaccggatggtccattctccttcagggcgccatatggtagagatcagcaccccagtg

SEQ ID NO: 2165 - DNA, 20 bp, Artificial Sequence
  Synthetic oligonucleotide
cctccaaagccattgtcaag

SEQ ID NO: 2166 - DNA, 21 bp, Artificial Sequence
  Synthetic oligonucleotide
ctttgagagccagagttcagc

SEQ ID NO: 2167 - DNA, 24 bp, Artificial Sequence
  Synthetic oligonucleotide
cacagcagtcatctgcaccagtcc

SEQ ID NO: 2168 - DNA, 68 bp, Artificial Sequence
  Synthetic oligonucleotide
cctccaaagccattgtcaagaccacagcagtcatctgcaccagtccagctgaactctggctctcaaag

SEQ ID NO: 2169 - DNA, 21 bp, Artificial Sequence
  Synthetic oligonucleotide
gtccaaggcacatatccactg

SEQ ID NO: 2170 - DNA, 18 bp, Artificial Sequence
  Synthetic oligonucleotide
gaagcagcctcccgattt

SEQ ID NO: 2171 - DNA, 24 bp, Artificial Sequence
  Synthetic oligonucleotide
caccgagttctctgctttcaccga

SEQ ID NO: 2172 - DNA, 70 bp, Artificial Sequence
  Synthetic oligonucleotide
gtccaaggcacatatccactgctcggtgaaagcagagaactcggtggcggccaaatcgggaggctgcttc

SEQ ID NO: 2173 - DNA, 20 bp, Artificial Sequence
  Synthetic oligonucleotide
agcgggtgctagagcttgta

SEQ ID NO: 2174 - DNA, 18 bp, Artificial Sequence
  Synthetic oligonucleotide
atggcacttcggtctcca

SEQ ID NO: 2175 - DNA, 25 bp, Artificial Sequence
  Synthetic oligonucleotide
ccatcactgccaacaagaacacctg

SEQ ID NO: 2176 - DNA, 67 bp, Artificial Sequence
  Synthetic oligonucleotide
agcgggtgctagagcttgtatccatcactgccaacaagaacacctgtcctggagaccgaagtgccat

SEQ ID NO: 2177 - DNA, 20 bp, Artificial Sequence
  Synthetic oligonucleotide
gatggtaggaagggatgtgc

SEQ ID NO: 2178 - DNA, 21 bp, Artificial Sequence
  Synthetic oligonucleotide
cacaaggagctgtgaatgagg

SEQ ID NO: 2179 - DNA, 23 bp, Artificial Sequence
  Synthetic oligonucleotide
cgcctctccacgcactcagctat

SEQ ID NO: 2180 - DNA, 66 bp, Artificial Sequence
  Synthetic oligonucleotide
gatggtaggaagggatgtgcccgcctctccacgcactcagctatacctcattcacagctccttgtg

SEQ ID NO: 2181 - DNA, 20 bp, Artificial Sequence
  Synthetic oligonucleotide
ctaggacagcttggcttcca

SEQ ID NO: 2182 - DNA, 20 bp, Artificial Sequence
  Synthetic oligonucleotide
cataaccgtagggctccaca

SEQ ID NO: 2183 - DNA, 24 bp, Artificial Sequence
  Synthetic oligonucleotide
cgccacaatgccctcatagttgac

SEQ ID NO: 2184 - DNA, 67 bp, Artificial Sequence
  Synthetic oligonucleotide
ctaggacagcttggcttccatgtcaactatgagggcattgtggcggatgtggagccctacggttatg

SEQ ID NO: 2185 - DNA, 21 bp, Artificial Sequence
  Synthetic oligonucleotide
agaggctgaatatgcaggaca

SEQ ID NO: 2186 - DNA, 18 bp, Artificial Sequence
  Synthetic oligonucleotide
ctatcggcctcagcatgg

SEQ ID NO: 2187 - DNA, 24 bp, Artificial Sequence
  Synthetic oligonucleotide
ccaatctctgcctcagttctgcca

SEQ ID NO: 2188 - DNA, 66 bp, Artificial Sequence
  Synthetic oligonucleotide
agaggctgaatatgcaggacagttggcagaactgaggcagagattggaccatgctgaggccgatag

SEQ ID NO: 2189 - DNA, 20 bp, Artificial Sequence
  Synthetic oligonucleotide
atcgtcagcgagtttgacct

SEQ ID NO: 2190 - DNA, 18 bp, Artificial Sequence
  Synthetic oligonucleotide
caggatggcttgggtgag

SEQ ID NO: 2191 - DNA, 24 bp, Artificial Sequence
  Synthetic oligonucleotide
cagcatccacgcattgacacagac

SEQ ID NO: 2192 - DNA, 66 bp, Artificial Sequence
  Synthetic oligonucleotide
atcgtcagcgagtttgaccttgtctgtgtcaatgcgtggatgctggacctcacccaagccatcctg

SEQ ID NO: 2193 - DNA, 22 bp, Artificial Sequence
  Synthetic oligonucleotide
aagtgtttttcccccttgagat

SEQ ID NO: 2194 - DNA, 21 bp, Artificial Sequence
  Synthetic oligonucleotide
ggccgatcgatagtctctctt

SEQ ID NO: 2195 - DNA, 26 bp, Artificial Sequence
  Synthetic oligonucleotide
tcatggtgctgcatagcaaatatcca

SEQ ID NO: 2196 - DNA, 73 bp, Artificial Sequence
  Synthetic oligonucleotide
aagtgtttttcccccttgagataatggatatttgctatgcagcaccatgaagaagagagactatcgatcggcc

SEQ ID NO: 2197 - DNA, 20 bp, Artificial Sequence
  Synthetic oligonucleotide
aggaccgtagctgcacagac

SEQ ID NO: 2198 - DNA, 18 bp, Artificial Sequence
  Synthetic oligonucleotide
atcccatcccaatgcaga

SEQ ID NO: 2199 - DNA, 24 bp, Artificial Sequence
  Synthetic oligonucleotide
taccatggctgctgctcttcatcc

SEQ ID NO: 2200 - DNA, 66 bp, Artificial Sequence
  Synthetic oligonucleotide
aggaccgtagctgcacagacataccatggctgctgctcttcatcctcttctgcattgggatgggat

SEQ ID NO: 2201 - DNA, 22 bp, Artificial Sequence
  Synthetic oligonucleotide
ggacattactggcctgttcaca

SEQ ID NO: 2202 - DNA, 23 bp, Artificial Sequence
  Synthetic oligonucleotide
accaatactcaggagcaggatga

SEQ ID NO: 2203 - DNA, 23 bp, Artificial Sequence
  Synthetic oligonucleotide
tgcattccagcctcccatttcca

SEQ ID NO: 2204 - DNA, 76 bp, Artificial Sequence
  Synthetic oligonucleotide
ggacattactggcctgttcacaatgagcttgcattccagcctcccatttccaatcatcctgctcctgagtattggt

SEQ ID NO: 2205 - DNA, 18 bp, Artificial Sequence
  Synthetic oligonucleotide
taccgactgaacccccaa

SEQ ID NO: 2206 - DNA, 20 bp, Artificial Sequence
  Synthetic oligonucleotide
gacatcacccgctaggtttc

SEQ ID NO: 2207 - DNA, 24 bp, Artificial Sequence
  Synthetic oligonucleotide
tatcttacctctaccgcctgccgc

SEQ ID NO: 2208 - DNA, 66 bp, Artificial Sequence
  Synthetic oligonucleotide
taccgactgaacccccaagagtatcttacctctaccgcctgccgccgaaacctagcgggtgatgtc

SEQ ID NO: 2209 - DNA, 20 bp, Artificial Sequence
  Synthetic oligonucleotide
ccgagttagcatatcccagg

SEQ ID NO: 2210 - DNA, 18 bp, Artificial Sequence
  Synthetic oligonucleotide
cctttgtgcccagctgtc

SEQ ID NO: 2211 - DNA, 24 bp, Artificial Sequence
  Synthetic oligonucleotide
cccacccttgctgtgttgagtctg

SEQ ID NO: 2212 - DNA, 67 bp, Artificial Sequence
  Synthetic oligonucleotide
ccgagttagcatatcccaggctcgcagactcaacacagcaagggtgggagacagctgggcacaaagg

SEQ ID NO: 2213 - DNA, 18 bp, Artificial Sequence
  Synthetic oligonucleotide
ggcatccagtgccagaac

SEQ ID NO: 2214 - DNA, 18 bp, Artificial Sequence
  Synthetic oligonucleotide
cgcgatgtagctgtgcat

SEQ ID NO: 2215 - DNA, 24 bp, Artificial Sequence
  Synthetic oligonucleotide
cttcacagaggctgagcaccagga

SEQ ID NO: 2216 - DNA, 66 bp, Artificial Sequence
  Synthetic oligonucleotide
ggcatccagtgccagaacccgctcttcacagaggctgagcaccaggacatgcacagctacatcgcg

SEQ ID NO: 2217 - DNA, 20 bp, Artificial Sequence
  Synthetic oligonucleotide
cccaatcggaagcctaacta

SEQ ID NO: 2218 - DNA, 20 bp, Artificial Sequence
  Synthetic oligonucleotide
gtagggctgctggaaggtaa

SEQ ID NO: 2219 - DNA, 25 bp, Artificial Sequence
  Synthetic oligonucleotide
tctggattagagtcctgcagctcgc

SEQ ID NO: 2220 - DNA, 69 bp, Artificial Sequence
  Synthetic oligonucleotide
cccaatcggaagcctaactacagcgagctgcaggactctaatccagagtttaccttccagcagccctac

SEQ ID NO: 2221 - DNA, 20 bp, Artificial Sequence
  Synthetic oligonucleotide
cgtttcctgcttttggttct

SEQ ID NO: 2222 - DNA, 18 bp, Artificial Sequence
  Synthetic oligonucleotide
aggtagaaggcgcacgaa

SEQ ID NO: 2223 - DNA, 24 bp, Artificial Sequence
  Synthetic oligonucleotide
cccacctaaggcctacgccgacta

SEQ ID NO: 2224 - DNA, 67 bp, Artificial Sequence
  Synthetic oligonucleotide
cgtttcctgcttttggttcttacagtagtcggcgtaggccttaggtgggttcgtgcgccttctacct

SEQ ID NO: 2225 - DNA, 20 bp, Artificial Sequence
  Synthetic oligonucleotide
tgaagagaggcatgttggag

SEQ ID NO: 2226 - DNA, 20 bp, Artificial Sequence
  Synthetic oligonucleotide
aatagacacatcggccacac

SEQ ID NO: 2227 - DNA, 24 bp, Artificial Sequence
  Synthetic oligonucleotide
tttgtcagcagtcacattgcccaa

SEQ ID NO: 2228 - DNA, 70 bp, Artificial Sequence
  Synthetic oligonucleotide
tgaagagaggcatgttggagacttgggcaatgtgactgctgacaaagatggtgtggccgatgtgtctatt

SEQ ID NO: 2229 - DNA, 20 bp, Artificial Sequence
  Synthetic oligonucleotide
gcagatgagtggaggctttc

SEQ ID NO: 2230 - DNA, 18 bp, Artificial Sequence
  Synthetic oligonucleotide
agcgagtgaagagggctg

SEQ ID NO: 2231 - DNA, 24 bp, Artificial Sequence
  Synthetic oligonucleotide
atttccattggcatcagcactgga

SEQ ID NO: 2232 - DNA, 66 bp, Artificial Sequence
  Synthetic oligonucleotide
gcagatgagtggaggctttcttccagtgctgatgccaatggaaatgcccagccctcttcactcgct

SEQ ID NO: 2233 - DNA, 20 bp, Artificial Sequence
  Synthetic oligonucleotide
agatgatctcgggagactgg

SEQ ID NO: 2234 - DNA, 18 bp, Artificial Sequence
  Synthetic oligonucleotide
gcgcccttcagtaggtga

SEQ ID NO: 2235 - DNA, 24 bp, Artificial Sequence
  Synthetic oligonucleotide
cgagtccagcatctccaacctggt

SEQ ID NO: 2236 - DNA, 66 bp, Artificial Sequence
  Synthetic oligonucleotide
agatgatctcgggagactggctcgagtccagcatctccaacctggttttcacctactgaagggcgc

SEQ ID NO: 2237 - DNA, 23 bp, Artificial Sequence
  Synthetic oligonucleotide
tcttccctgtacactggcagttc

SEQ ID NO: 2238 - DNA, 20 bp, Artificial Sequence
  Synthetic oligonucleotide
agctcggtgtgggagaggta

SEQ ID NO: 2239 - DNA, 22 bp, Artificial Sequence
  Synthetic oligonucleotide
tggaccagcaccccattgacgg

SEQ ID NO: 2240 - DNA, 73 bp, Artificial Sequence
  Synthetic oligonucleotide
tcttccctgtacactggcagttcggccagctggaccagcaccccattgacgggtacctctcccacaccgagct

SEQ ID NO: 2241 - DNA, 19 bp, Artificial Sequence
  Synthetic oligonucleotide
ggcacagtgcaagtgatga

SEQ ID NO: 2242 - DNA, 19 bp, Artificial Sequence
  Synthetic oligonucleotide
gattgagctctctcggcct

SEQ ID NO: 2243 - DNA, 24 bp, Artificial Sequence
  Synthetic oligonucleotide
acttcatcccaagccaggcctttc

SEQ ID NO: 2244 - DNA, 67 bp, Artificial Sequence
  Synthetic oligonucleotide
ggcacagtgcaagtgatgactacttcatcccaagccaggcctttctggaggccgagagagctcaatc

SEQ ID NO: 2245 - DNA, 20 bp, Artificial Sequence
  Synthetic oligonucleotide
ccatccgccagtattacaag

SEQ ID NO: 2246 - DNA, 19 bp, Artificial Sequence
  Synthetic oligonucleotide
gggtgcacgaactggtaga

SEQ ID NO: 2247 - DNA, 24 bp, Artificial Sequence
  Synthetic oligonucleotide
atcatccggaagccagacatctcc

SEQ ID NO: 2248 - DNA, 79 bp, Artificial Sequence
  Synthetic oligonucleotide
ccatccgccagtattacaagaagggcatcatccggaagccagacatctcccagcgcctcgtctaccagttcgtgcaccc

SEQ ID NO: 2249 - DNA, 20 bp, Artificial Sequence
  Synthetic oligonucleotide
ctgccatatgacccttccag

SEQ ID NO: 2250 - DNA, 19 bp, Artificial Sequence
  Synthetic oligonucleotide
gttgaaaactgcaccgcac

SEQ ID NO: 2251 - DNA, 24 bp, Artificial Sequence
  Synthetic oligonucleotide
accacgtctcttcagaagcctggg

SEQ ID NO: 2252 - DNA, 66 bp, Artificial Sequence
  Synthetic oligonucleotide
ctgccatatgacccttccagtcccaggcttctgaagagacgtggtaagtgcggtgcagttttcaac

SEQ ID NO: 2253 - DNA, 20 bp, Artificial Sequence
  Synthetic oligonucleotide
attcccagcacaggctctgt

SEQ ID NO: 2254 - DNA, 21 bp, Artificial Sequence
  Synthetic oligonucleotide
agatggctaccaccaccacaa

SEQ ID NO: 2255 - DNA, 26 bp, Artificial Sequence
  Synthetic oligonucleotide
ctgtcgcagtgttcctggtcatctgc

SEQ ID NO: 2256 - DNA, 76 bp, Artificial Sequence
  Synthetic oligonucleotide
attcccagcacaggctctgtggagatggctgtcgcagtgttcctggtcatctgcattgtggtggtggtagccatct

SEQ ID NO: 2257 - DNA, 19 bp, Artificial Sequence
  Synthetic oligonucleotide
tcacacatggaaagcgagg

SEQ ID NO: 2258 - DNA, 18 bp, Artificial Sequence
  Synthetic oligonucleotide
gttcaggtcctgggcaac

SEQ ID NO: 2259 - DNA, 24 bp, Artificial Sequence
  Synthetic oligonucleotide
tgaatggtgcatacaaggccatcc

SEQ ID NO: 2260 - DNA, 66 bp, Artificial Sequence
  Synthetic oligonucleotide
tcacacatggaaagcgaggagttgaatggtgcatacaaggccatccccgttgcccaggacctgaac

SEQ ID NO: 2261 - DNA, 20 bp, Artificial Sequence
  Synthetic oligonucleotide
attttcgaggccaaaaaatc

SEQ ID NO: 2262 - DNA, 20 bp, Artificial Sequence
  Synthetic oligonucleotide
cctgagcaaggatattcacg

SEQ ID NO: 2263 - DNA, 28 bp, Artificial Sequence
  Synthetic oligonucleotide
tgggcaagaaaaacatctcattcctttg

SEQ ID NO: 2264 - DNA, 76 bp, Artificial Sequence
  Synthetic oligonucleotide
attttcgaggccaaaaaatcattttactgggcaagaaaaacatctcattcctttgtcgtgaatatccttgctcagg

SEQ ID NO: 2265 - DNA, 23 bp, Artificial Sequence
  Synthetic oligonucleotide
tgaggagtggtattttggcaaga

SEQ ID NO: 2266 - DNA, 21 bp, Artificial Sequence
  Synthetic oligonucleotide
ctctcgggttctctgcattga

SEQ ID NO: 2267 - DNA, 24 bp, Artificial Sequence
  Synthetic oligonucleotide
aaccgctctgactcccgtctggtg

SEQ ID NO: 2268 - DNA, 74 bp, Artificial Sequence
  Synthetic oligonucleotide
tgaggagtggtattttggcaagatcaccagacgggagtcagagcggttactgctcaatgcagagaacccgagag

SEQ ID NO: 2269 - DNA, 20 bp, Artificial Sequence
  Synthetic oligonucleotide
gggctggaatctgtctagga

SEQ ID NO: 2270 - DNA, 19 bp, Artificial Sequence
  Synthetic oligonucleotide
ccatgactgcacaatggct

SEQ ID NO: 2271 - DNA, 24 bp, Artificial Sequence
  Synthetic oligonucleotide
cctctctcggaggccacagaggct

SEQ ID NO: 2272 - DNA, 71 bp, Artificial Sequence
  Synthetic oligonucleotide
gggctggaatctgtctaggagccctctctcggaggccacagaggctgggggtagccattgtgcagtcatgg

SEQ ID NO: 2273 - DNA, 20 bp, Artificial Sequence
  Synthetic oligonucleotide
gtaggtctcctggcgttctg

SEQ ID NO: 2274 - DNA, 21 bp, Artificial Sequence
  Synthetic oligonucleotide
tccctggaagggtaggagtaa

SEQ ID NO: 2275 - DNA, 24 bp, Artificial Sequence
  Synthetic oligonucleotide
agacaccactcagaatccccaggc

SEQ ID NO: 2276 - DNA, 81 bp, Artificial Sequence
  Synthetic oligonucleotide
gtaggtctcctggcgttctgccagctggcctggggattctgagtggtgtctgcttagagtttactcctacccttccaggga

SEQ ID NO: 2277 - DNA, 18 bp, Artificial Sequence
  Synthetic oligonucleotide
cctgtcctgccagagcat

SEQ ID NO: 2278 - DNA, 18 bp, Artificial Sequence
  Synthetic oligonucleotide
cagctgcacaaaactggc

SEQ ID NO: 2279 - DNA, 24 bp, Artificial Sequence
  Synthetic oligonucleotide
agtcacgagcacccagcgaaactt

SEQ ID NO: 2280 - DNA, 66 bp, Artificial Sequence
  Synthetic oligonucleotide
cctgtcctgccagagcatggatgaagtttcgctgggtgctcgtgactggccagttttgtgcagctg

SEQ ID NO: 2281 - DNA, 20 bp, Artificial Sequence
  Synthetic oligonucleotide
gggctcagctttcagaagtg

SEQ ID NO: 2282 - DNA, 20 bp, Artificial Sequence
  Synthetic oligonucleotide
acatgttcagctggtccaca

SEQ ID NO: 2283 - DNA, 25 bp, Artificial Sequence
  Synthetic oligonucleotide
tggcagttttcttctgtcaccaaaa

SEQ ID NO: 2284 - DNA, 81 bp, Artificial Sequence
  Synthetic oligonucleotide
gggctcagctttcagaagtgctgagttggcagttttcttctgtcaccaaaagaggtctcaatgtggaccagctgaacatgt

SEQ ID NO: 2285 - DNA, 20 bp, Artificial Sequence
  Synthetic oligonucleotide
tcacatgccactttggtgtt

SEQ ID NO: 2286 - DNA, 20 bp, Artificial Sequence
  Synthetic oligonucleotide
cttgcaggaagcggctatac

SEQ ID NO: 2287 - DNA, 22 bp, Artificial Sequence
  Synthetic oligonucleotide
tcctgggagagattgaccagca

SEQ ID NO: 2288 - DNA, 70 bp, Artificial Sequence
  Synthetic oligonucleotide
tcacatgccactttggtgtttcataatctcctgggagagattgaccagcagtatagccgcttcctgcaag

SEQ ID NO: 2289 - DNA, 21 bp, Artificial Sequence
  Synthetic oligonucleotide
gaggcgctcaacatgaaattc

SEQ ID NO: 2290 - DNA, 20 bp, Artificial Sequence
  Synthetic oligonucleotide
gccaggaacacgaggttctc

SEQ ID NO: 2291 - DNA, 22 bp, Artificial Sequence
  Synthetic oligonucleotide
cggttgctctgcacttcggcct

SEQ ID NO: 2292 - DNA, 77 bp, Artificial Sequence
  Synthetic oligonucleotide
gaggcgctcaacatgaaattcaaggccgaagtgcagagcaaccggggcctgaccaaggagaacctcgtgttcctggc

SEQ ID NO: 2293 - DNA, 20 bp, Artificial Sequence
  Synthetic oligonucleotide
ccagtggtggtgatcgttca

SEQ ID NO: 2294 - DNA, 21 bp, Artificial Sequence
  Synthetic oligonucleotide
gcaaaagcattgtcccagaga

SEQ ID NO: 2295 - DNA, 23 bp, Artificial Sequence
  Synthetic oligonucleotide
cagccaggacaacaatgcgacgg

SEQ ID NO: 2296 - DNA, 74 bp, Artificial Sequence
  Synthetic oligonucleotide
ccagtggtggtgatcgttcatggcagccaggacaacaatgcgacggccactgttctctgggacaatgcttttgc

SEQ ID NO: 2297 - DNA, 20 bp, Artificial Sequence
  Synthetic oligonucleotide
aatacccaacgcacaaatga

SEQ ID NO: 2298 - DNA, 20 bp, Artificial Sequence
  Synthetic oligonucleotide
ggagacaatgcaaaccacac

SEQ ID NO: 2299 - DNA, 23 bp, Artificial Sequence
  Synthetic oligonucleotide
cacgttctctgccccgtttcttg

SEQ ID NO: 2300 - DNA, 71 bp, Artificial Sequence
  Synthetic oligonucleotide
aatacccaacgcacaaatgaccgcacgttctctgccccgtttcttgccccagtgtggtttgcattgtctcc

SEQ ID NO: 2301 - DNA, 25 bp, Artificial Sequence
  Synthetic oligonucleotide
gaagatccctttcctcctactgttc

SEQ ID NO: 2302 - DNA, 20 bp, Artificial Sequence
  Synthetic oligonucleotide
ggatgatgttcggccttgat

SEQ ID NO: 2303 - DNA, 22 bp, Artificial Sequence
  Synthetic oligonucleotide
ctgcgtggctctcggcttccca

SEQ ID NO: 2304 - DNA, 74 bp, Artificial Sequence
  Synthetic oligonucleotide
gaagatccctttcctcctactgttctttctgtgggaagccgagagccacgcagcatcaaggccgaacatcatcc

SEQ ID NO: 2305 - DNA, 20 bp, Artificial Sequence
  Synthetic oligonucleotide
tgcagttgtagggagtctgg

SEQ ID NO: 2306 - DNA, 20 bp, Artificial Sequence
  Synthetic oligonucleotide
tctcaagaattgccgttgac

SEQ ID NO: 2307 - DNA, 23 bp, Artificial Sequence
  Synthetic oligonucleotide
taccgtgccagcagaagccaaag

SEQ ID NO: 2308 - DNA, 69 bp, Artificial Sequence
  Synthetic oligonucleotide
tgcagttgtagggagtctggttaccgtgccagcagaagccaaagaaagagtcaacggcaattcttgaga

SEQ ID NO: 2309 - DNA, 20 bp, Artificial Sequence
  Synthetic oligonucleotide
gtgaagccaccgtcatcatg

SEQ ID NO: 2310 - DNA, 22 bp, Artificial Sequence
  Synthetic oligonucleotide
ccttccttcttatcccccaagt

SEQ ID NO: 2311 - DNA, 28 bp, Artificial Sequence
  Synthetic oligonucleotide
ctgaccaggaggcaaaaccttcaactga

SEQ ID NO: 2312 - DNA, 73 bp, Artificial Sequence
  Synthetic oligonucleotide
gtgaagccaccgtcatcatgtctgaccaggaggcaaaaccttcaactgaggacttgggggataagaaggaagg

SEQ ID NO: 2313 - DNA, 18 bp, Artificial Sequence
  Synthetic oligonucleotide
acttgcccagcacaagga

SEQ ID NO: 2314 - DNA, 20 bp, Artificial Sequence
  Synthetic oligonucleotide
gacaccatccgtgtcacatc

SEQ ID NO: 2315 - DNA, 24 bp, Artificial Sequence
  Synthetic oligonucleotide
accccaggactgatgtcaaggcat

SEQ ID NO: 2316 - DNA, 66 bp, Artificial Sequence
  Synthetic oligonucleotide
acttgcccagcacaaggaagaccccaggactgatgtcaaggcatacgatgtgacacggatggtgtc

SEQ ID NO: 2317 - DNA, 20 bp, Artificial Sequence
  Synthetic oligonucleotide
gcgctccactctcagtcttt

SEQ ID NO: 2318 - DNA, 20 bp, Artificial Sequence
  Synthetic oligonucleotide
cttgtgctcatggtgatggt

SEQ ID NO: 2319 - DNA, 24 bp, Artificial Sequence
  Synthetic oligonucleotide
agcctccaaacacagtgaccacca

SEQ ID NO: 2320 - DNA, 83 bp, Artificial Sequence
  Synthetic oligonucleotide
gcgctccactctcagtctttactaaggaatctacagcctccaaacacagtgaccaccatcaccaccatcaccatgagcacaag

SEQ ID NO: 2321 - DNA, 19 bp, Artificial Sequence
  Synthetic oligonucleotide
gagcaacacgattctggga

SEQ ID NO: 2322 - DNA, 21 bp, Artificial Sequence
  Synthetic oligonucleotide
ggcaccgttaaccagctaaat

SEQ ID NO: 2323 - DNA, 23 bp, Artificial Sequence
  Synthetic oligonucleotide
tcttcatggtgttcccctcctgg

SEQ ID NO: 2324 - DNA, 84 bp, Artificial Sequence
  Synthetic oligonucleotide
gagcaacacgattctgggatcccaggaggggaacaccatgaagactaacgacacatacatgaaatttagctggttaacggtgcc

SEQ ID NO: 2325 - DNA, 19 bp, Artificial Sequence
  Synthetic oligonucleotide
gcccgaaacgccgaatata

SEQ ID NO: 2326 - DNA, 23 bp, Artificial Sequence
  Synthetic oligonucleotide
cgtggctctcttatcctcatgat

SEQ ID NO: 2327 - DNA, 21 bp, Artificial Sequence
  Synthetic oligonucleotide
taccgcagcaaaccgcttggg

SEQ ID NO: 2328 - DNA, 65 bp, Artificial Sequence
  Synthetic oligonucleotide
gcccgaaacgccgaatataatcccaagcggtttgctgcggtaatcatgaggataagagagccacg

SEQ ID NO: 2329 - DNA, 20 bp, Artificial Sequence
  Synthetic oligonucleotide
tgcgaagtgcttttgtttgt

SEQ ID NO: 2330 - DNA, 20 bp, Artificial Sequence
  Synthetic oligonucleotide
gccttccagacagtctccat

SEQ ID NO: 2331 - DNA, 24 bp, Artificial Sequence
  Synthetic oligonucleotide
cgcaccagcatggcaataagcttt

SEQ ID NO: 2332 - DNA, 83 bp, Artificial Sequence
  Synthetic oligonucleotide
tgcgaagtgcttttgtttgtttgttttcgtttggttaaagcttattgccatgctggtgcggctatggagactgtctggaaggc

SEQ ID NO: 2333 - DNA, 19 bp, Artificial Sequence
  Synthetic oligonucleotide
gccctcccagtgtgcaaat

SEQ ID NO: 2334 - DNA, 25 bp, Artificial Sequence
  Synthetic oligonucleotide
cgtcgatggtattaggatagaagca

SEQ ID NO: 2335 - DNA, 23 bp, Artificial Sequence
  Synthetic oligonucleotide
tgctgtttcgacgacaccgttcg

SEQ ID NO: 2336 - DNA, 86 bp, Artificial Sequence
  Synthetic oligonucleotide
gccctcccagtgtgcaaataagggctgctgtttcgacgacaccgttcgtggggtcccctggtgcttctatcctaataccatcgacg

SEQ ID NO: 2337 - DNA, 25 bp, Artificial Sequence
  Synthetic oligonucleotide
aggcactgttcatctcagtttttct

SEQ ID NO: 2338 - DNA, 25 bp, Artificial Sequence
  Synthetic oligonucleotide
catcaggctccagatatgaactttc

SEQ ID NO: 2339 - DNA, 25 bp, Artificial Sequence
  Synthetic oligonucleotide
cagaagcgcttgccgggagcaaagg

SEQ ID NO: 2340 - DNA, 80 bp, Artificial Sequence
  Synthetic oligonucleotide
aggcactgttcatctcagcttttctgtccctttgctcccggcaagcgcttctgctgaaagttcatatctggagcctgatg

SEQ ID NO: 2341 - DNA, 20 bp, Artificial Sequence
  Synthetic oligonucleotide
ggtgtgccacagaccttcct

SEQ ID NO: 2342 - DNA, 24 bp, Artificial Sequence
  Synthetic oligonucleotide
acggagttcttgacagagttttga

SEQ ID NO: 2343 - DNA, 27 bp, Artificial Sequence
  Synthetic oligonucleotide
ttggcctgtaatcacctgtgcagcctt

SEQ ID NO: 2344 - DNA, 83 bp, Artificial Sequence
  Synthetic oligonucleotide
ggtgtgccacagaccttcctacttggcctgtaatcacctgtgcagccttttgtgggccttcaaaactctgtcaagaactccgt

SEQ ID NO: 2345 - DNA, 20 bp, Artificial Sequence
  Synthetic oligonucleotide
gctactttgagcgcttctcg

SEQ ID NO: 2346 - DNA, 19 bp, Artificial Sequence
  Synthetic oligonucleotide
ggtcaccatcttgtgtcgg

SEQ ID NO: 2347 - DNA, 24 bp, Artificial Sequence
  Synthetic oligonucleotide
caagatgtggcttctgcaaccagc

SEQ ID NO: 2348 - DNA, 68 bp, Artificial Sequence
  Synthetic oligonucleotide
gctactttgagcgcttctcgccaagatgtggcttctgcaaccagcccatccgacacaagatggtgacc

SEQ ID NO: 2349 - DNA, 20 bp, Artificial Sequence
  Synthetic oligonucleotide
accagtcccccagaagacta

SEQ ID NO: 2350 - DNA, 20 bp, Artificial Sequence
  Synthetic oligonucleotide
cctggtgctgttgtagatgg

SEQ ID NO: 2351 - DNA, 21 bp, Artificial Sequence
  Synthetic oligonucleotide
tcctgagcccgaggaagtccc

SEQ ID NO: 2352 - DNA, 75 bp, Artificial Sequence
  Synthetic oligonucleotide
accagtcccccagaagactatcctgagcccgaggaagtccccccggaggtgatttccatctacaacagcaccagg

SEQ ID NO: 2353 - DNA, 22 bp, Artificial Sequence
  Synthetic oligonucleotide
ggatcgagctcttccagatcct

SEQ ID NO: 2354 - DNA, 20 bp, Artificial Sequence
  Synthetic oligonucleotide
gccaccgatatagcgctgtt

SEQ ID NO: 2355 - DNA, 21 bp, Artificial Sequence
  Synthetic oligonucleotide
cggccagatgagcacattgcc

SEQ ID NO: 2356 - DNA, 65 bp, Artificial Sequence
  Synthetic oligonucleotide
ggatcgagctcttccagatccttcggccagatgagcacattgccaaacagcgctatatcggtggc

SEQ ID NO: 2357 - DNA, 20 bp, Artificial Sequence
  Synthetic oligonucleotide
aacaccaatgggttccatct

SEQ ID NO: 2358 - DNA, 20 bp, Artificial Sequence
  Synthetic oligonucleotide
cctcttcatcaggccaaact

SEQ ID NO: 2359 - DNA, 24 bp, Artificial Sequence
  Synthetic oligonucleotide
ttctgggctcctgattgctcaagc

SEQ ID NO: 2360 - DNA, 66 bp, Artificial Sequence
  Synthetic oligonucleotide
aacaccaatgggttccatctttctgggctcctgattgctcaagcacagtttggcctgatgaagagg

SEQ ID NO: 2361 - DNA, 28 bp, Artificial Sequence
  Synthetic oligonucleotide
caagactggctacatcagagtcttagtg

SEQ ID NO: 2362 - DNA, 25 bp, Artificial Sequence
  Synthetic oligonucleotide
cagcgtaggtttggtcatagatagg

SEQ ID NO: 2363 - DNA, 29 bp, Artificial Sequence
  Synthetic oligonucleotide
tgagtctgccatgacctgttttccttcat

SEQ ID NO: 2364 - DNA, 86 bp, Artificial Sequence
  Synthetic oligonucleotide
caagactggctacatcagagtcttagtgcatgaaggaaaacaggtcatggcagactcaggacctatctatgaccaaacctacgctg

SEQ ID NO: 2365 - DNA, 20 bp, Artificial Sequence
  Synthetic oligonucleotide
ggacaagaccctctcaggct

SEQ ID NO: 2366 - DNA, 18 bp, Artificial Sequence
  Synthetic oligonucleotide
ttggaggctgtgggtcag

SEQ ID NO: 2367 - DNA, 24 bp, Artificial Sequence
  Synthetic oligonucleotide
caagctcccaagagcttccagagc

SEQ ID NO: 2368 - DNA, 67 bp, Artificial Sequence
  Synthetic oligonucleotide
ggacaagaccctctcaggctgtcccaagctcccaagagcttccagagctctgacccacagcctccaa

SEQ ID NO: 2369 - DNA, 18 bp, Artificial Sequence
  Synthetic oligonucleotide
gtccctggctgaaaatgg

SEQ ID NO: 2370 - DNA, 19 bp, Artificial Sequence
  Synthetic oligonucleotide
gggctcccgaagtcttcta

SEQ ID NO: 2371 - DNA, 24 bp, Artificial Sequence
  Synthetic oligonucleotide
tggagcccttctcccaagatggta

SEQ ID NO: 2372 - DNA, 66 bp, Artificial Sequence
  Synthetic oligonucleotide
gtccctggctgaaaatggcctggagcccttctcccaagatggtaccctagaagacttcgggagccc

SEQ ID NO: 2373 - DNA, 22 bp, Artificial Sequence
  Synthetic oligonucleotide
tcaccctctgtgacttcatcgt

SEQ ID NO: 2374 - DNA, 22 bp, Artificial Sequence
  Synthetic oligonucleotide
tgtggttcaggctcttcttctg

SEQ ID NO: 2375 - DNA, 22 bp, Artificial Sequence
  Synthetic oligonucleotide
ccctgggacaccctgagcacca

SEQ ID NO: 2376 - DNA, 69 bp, Artificial Sequence
  Synthetic oligonucleotide
tcaccctctgtgacttcatcgtgccctgggacaccctgagcaccacccagaagaagagcctgaaccaca

SEQ ID NO: 2377 - DNA, 20 bp, Artificial Sequence
  Synthetic oligonucleotide
ctacctgccttgctttgtga

SEQ ID NO: 2378 - DNA, 20 bp, Artificial Sequence
  Synthetic oligonucleotide
accgaaattggagagcatgt

SEQ ID NO: 2379 - DNA, 24 bp, Artificial Sequence
  Synthetic oligonucleotide
ccaagaacgagtgtctctggaccg

SEQ ID NO: 2380 - DNA, 67 bp, Artificial Sequence
  Synthetic oligonucleotide
ctacctgccttgctttgtgacttccaagaacgagtgtctctggaccgacatgctctccaatttcggt

SEQ ID NO: 2381 - DNA, 20 bp, Artificial Sequence
  Synthetic oligonucleotide
gccgggaagaccgtaattgt

SEQ ID NO: 2382 - DNA, 18 bp, Artificial Sequence
  Synthetic oligonucleotide
cagcggcaccaggttcag

SEQ ID NO: 2383 - DNA, 26 bp, Artificial Sequence
  Synthetic oligonucleotide
caaatggcttcctctggaaggtccca

SEQ ID NO: 2384 - DNA, 84 bp, Artificial Sequence
  Synthetic oligonucleotide
gccgggaagaccgtaattgtggctgcactggatgggaccttccagaggaagccatttggggccatcctgaacctggtgccgctg

SEQ ID NO: 2385 - DNA, 20 bp, Artificial Sequence
  Synthetic oligonucleotide
ggacagtgtgcacctcaaag

SEQ ID NO: 2386 - DNA, 18 bp, Artificial Sequence
  Synthetic oligonucleotide
ctcccacgaggaaggtcc

SEQ ID NO: 2387 - DNA, 24 bp, Artificial Sequence
  Synthetic oligonucleotide
aagcactgtgcatcaccttgaccc

SEQ ID NO: 2388 - DNA, 72 bp, Artificial Sequence
  Synthetic oligonucleotide
ggacagtgtgcacctcaaagactaagaaagcactgtgcatcaccttgaccctggggaccttcctcgtgggag

SEQ ID NO: 2389 - DNA, 15 bp, Artificial Sequence
  Synthetic oligonucleotide
gaggcggagggcgag

SEQ ID NO: 2390 - DNA, 20 bp, Artificial Sequence
  Synthetic oligonucleotide
actggtcctcactcacaact

SEQ ID NO: 2391 - DNA, 22 bp, Artificial Sequence
  Synthetic oligonucleotide
taaggcttcctgccgcgctcca

SEQ ID NO: 2392 - DNA, 82 bp, Artificial Sequence
  Synthetic oligonucleotide
gaggcggaggcggagggcgaggggcggggagcgccgcctggagcgcggcaggaagccttatcagttgtgagtgaggaccagt

SEQ ID NO: 2393 - DNA, 15 bp, Artificial Sequence
  Synthetic oligonucleotide
gaggcggagggcgag

SEQ ID NO: 2394 - DNA, 20 bp, Artificial Sequence
  Synthetic oligonucleotide
ttcctcgggtctccaaagat

SEQ ID NO: 2395 - DNA, 20 bp, Artificial Sequence
  Synthetic oligonucleotide
cctggaataacctgccgcgc

SEQ ID NO: 2396 - DNA, 76 bp, Artificial Sequence
  Synthetic oligonucleotide
gaggcggagggcgaggggcggggagcgccgcctggagcgcggcaggttattccaggatctttggagacccgaggaa

SEQ ID NO: 2397 - DNA, 20 bp, Artificial Sequence
  Synthetic oligonucleotide
ggagaagggtgaccgactca

SEQ ID NO: 2398 - DNA, 18 bp, Artificial Sequence
  Synthetic oligonucleotide
tgcccagactcggcaaag

SEQ ID NO: 2399 - DNA, 24 bp, Artificial Sequence
  Synthetic oligonucleotide
cgctgagatcaatcggcccgacta

SEQ ID NO: 2400 - DNA, 69 bp, Artificial Sequence
  Synthetic oligonucleotide
ggagaagggtgaccgactcagcgctgagatcaatcggcccgactatctcgactttgccgagtctgggca

SEQ ID NO: 2401 - DNA, 21 bp, Artificial Sequence
  Synthetic oligonucleotide
tgcacagagggtgtgggttac

SEQ ID NO: 2402 - DNA, 28 bp, Artificial Sequence
  Synthetic oligonucleotide
tcttcatctgatttacaagctgtacatg

SEQ ID NO: 2403 - DNA, 29 bp, Artificial Sequence
  Synthetic oligonucleotide
caatgcttccaacaatttgtttgcttgcc

SEQ ID NO: 2404 - DNA, 83 bp, Artificial Sequence
  Synthetic oligonucleotide
tgcacagagggtgtgggttacaccaatgcttccaacaatttgtttgcttgcctcccatgtacagcttgtaaatcagatgaaga

SEQ ID NO: 2405 - DNA, 24 bp, Artificial Sequence
  Synthetic oligonucleotide
ctctgagacagtgcttcgatgact

SEQ ID NO: 2406 - DNA, 19 bp, Artificial Sequence
  Synthetic oligonucleotide
ccatgaggcccaacttcct

SEQ ID NO: 2407 - DNA, 23 bp, Artificial Sequence
  Synthetic oligonucleotide
cagacttggtgccctttgactcc

SEQ ID NO: 2408 - DNA, 84 bp, Artificial Sequence
  Synthetic oligonucleotide
ctctgagacagtgcttcgatgactttgcagacttggtgccctttgactcctgggagccgctcatgaggaagttgggcctcatgg

SEQ ID NO: 2409 - DNA, 18 bp, Artificial Sequence
  Synthetic oligonucleotide
cagaagctgccagttccc

SEQ ID NO: 2410 - DNA, 18 bp, Artificial Sequence
  Synthetic oligonucleotide
cacccacaggtctcccag

SEQ ID NO: 2411 - DNA, 22 bp, Artificial Sequence
  Synthetic oligonucleotide
ccttctcctctgccgatcgctc

SEQ ID NO: 2412 - DNA, 79 bp, Artificial Sequence
  Synthetic oligonucleotide
cagaagctgccagttccccgaggaagagcggggcgagcgatcggcagaggagaaggggcggctgggagacctgtgggtg

SEQ ID NO: 2413 - DNA, 22 bp, Artificial Sequence
  Synthetic oligonucleotide
cttcacagtgctcctgcagtct

SEQ ID NO: 2414 - DNA, 21 bp, Artificial Sequence
  Synthetic oligonucleotide
catctgcttcagctcgttggt

SEQ ID NO: 2415 - DNA, 26 bp, Artificial Sequence
  Synthetic oligonucleotide
aagtacacgtaagttacagccacaca

SEQ ID NO: 2416 - DNA, 73 bp, Artificial Sequence
  Synthetic oligonucleotide
cttcacagtgctcctgcagtctctctgtgtggctgtaacttacgtgtactttaccaacgagctgaagcagatg

SEQ ID NO: 2417 - DNA, 19 bp, Artificial Sequence
  Synthetic oligonucleotide
aactgcatgtgggctatgg

SEQ ID NO: 2418 - DNA, 20 bp, Artificial Sequence
  Synthetic oligonucleotide
tgacaccctctccacttcag

SEQ ID NO: 2419 - DNA, 23 bp, Artificial Sequence
  Synthetic oligonucleotide
acatgaccagggaccaacccctc

SEQ ID NO: 2420 - DNA, 74 bp, Artificial Sequence
  Synthetic oligonucleotide
aactgcatgtgggctatgggaggggttggtccctggtcatgtgccccttcgcagctgaagtggagagggtgtca

SEQ ID NO: 2421 - DNA, 20 bp, Artificial Sequence
  Synthetic oligonucleotide
aatccaagggggagagtgat

SEQ ID NO: 2422 - DNA, 20 bp, Artificial Sequence
  Synthetic oligonucleotide
gtacagattttgcccgagga

SEQ ID NO: 2423 - DNA, 26 bp, Artificial Sequence
  Synthetic oligonucleotide
catatggactttgactcagctgtggc

SEQ ID NO: 2424 - DNA, 72 bp, Artificial Sequence
  Synthetic oligonucleotide
aatccaagggggagagtgatgacttccatatggactttgactcagctgtggctcctcgggcaaaatctgtac

SEQ ID NO: 2425 - DNA, 20 bp, Artificial Sequence
  Synthetic oligonucleotide
ctttgaacccttgcttgcaa

SEQ ID NO: 2426 - DNA, 18 bp, Artificial Sequence
  Synthetic oligonucleotide
cccgggacaaagcaaatg

SEQ ID NO: 2427 - DNA, 25 bp, Artificial Sequence
  Synthetic oligonucleotide
aagtcctgggtgcttctgacgcaca

SEQ ID NO: 2428 - DNA, 68 bp, Artificial Sequence
  Synthetic oligonucleotide
ctttgaacccttgcttgcaataggtgtgcgtcagaagcacccaggacttccatttgctttgtcccggg

SEQ ID NO: 2429 - DNA, 20 bp, Artificial Sequence
  Synthetic oligonucleotide
ccccaagcagtgcctctaca

SEQ ID NO: 2430 - DNA, 23 bp, Artificial Sequence
  Synthetic oligonucleotide
gaatcgcacagcatcaataacac

SEQ ID NO: 2431 - DNA, 21 bp, Artificial Sequence
  Synthetic oligonucleotide
cccgggtctcactggagccca

SEQ ID NO: 2432 - DNA, 77 bp, Artificial Sequence
  Synthetic oligonucleotide
ccccaagcagtgcctctacagtcagtgtgggctccagtgagacccggggtgagcgtgttattgatgctgtgcgattc

SEQ ID NO: 2433 - DNA, 22 bp, Artificial Sequence
  Synthetic oligonucleotide
gcctgtgagattcctacctttg

SEQ ID NO: 2434 - DNA, 19 bp, Artificial Sequence
  Synthetic oligonucleotide
atgtgcttggacctcgctt

SEQ ID NO: 2435 - DNA, 24 bp, Artificial Sequence
  Synthetic oligonucleotide
tctgctacccactgccagatgctg

SEQ ID NO: 2436 - DNA, 67 bp, Artificial Sequence
  Synthetic oligonucleotide
gcctgtgagattcctacctttgttctgctacccactgccagatgctgcaagcgaggtccaagcacat

SEQ ID NO: 2437 - DNA, 21 bp, Artificial Sequence
  Synthetic oligonucleotide
tctctgagctctgcatttgtc

SEQ ID NO: 2438 - DNA, 20 bp, Artificial Sequence
  Synthetic oligonucleotide
ggctctaaggcaggatgcta

SEQ ID NO: 2439 - DNA, 25 bp, Artificial Sequence
  Synthetic oligonucleotide
ttctccagctgaccctggttctctc

SEQ ID NO: 2440 - DNA, 71 bp, Artificial Sequence
  Synthetic oligonucleotide
tctctgagctctgcatttgtctattctccagctgaccctggttctctctcttagcatcctgccttagagcc

SEQ ID NO: 2441 - DNA, 20 bp, Artificial Sequence
  Synthetic oligonucleotide
aggagatgcagctgaaggag

SEQ ID NO: 2442 - DNA, 20 bp, Artificial Sequence
  Synthetic oligonucleotide
ccacctcttcatatttgcgg

SEQ ID NO: 2443 - DNA, 24 bp, Artificial Sequence
  Synthetic oligonucleotide
ccaagcacatcgctgaggattcag

SEQ ID NO: 2444 - DNA, 66 bp, Artificial Sequence
  Synthetic oligonucleotide
aggagatgcagctgaaggaggccaagcacatcgctgaggattcagaccgcaaatatgaagaggtgg

SEQ ID NO: 2445 - DNA, 20 bp, Artificial Sequence
  Synthetic oligonucleotide
taaccgtggcatctacctcc

SEQ ID NO: 2446 - DNA, 18 bp, Artificial Sequence
  Synthetic oligonucleotide
atgccaacgccatgatct

SEQ ID NO: 2447 - DNA, 24 bp, Artificial Sequence
  Synthetic oligonucleotide
atcctgttcaggtggctgcacctt

SEQ ID NO: 2448 - DNA, 66 bp, Artificial Sequence
  Synthetic oligonucleotide
taaccgtggcatctacctccgagatcctgttcaggtggctgcaccttcagatcatggcgttggcat

SEQ ID NO: 2449 - DNA, 20 bp, Artificial Sequence
  Synthetic oligonucleotide
tcagctgtgagctgcggata

SEQ ID NO: 2450 - DNA, 24 bp, Artificial Sequence
  Synthetic oligonucleotide
acggtcctaggtttgaggttaaga

SEQ ID NO: 2451 - DNA, 19 bp, Artificial Sequence
  Synthetic oligonucleotide
caggtcccattgccgggcg

SEQ ID NO: 2452 - DNA, 65 bp, Artificial Sequence
  Synthetic oligonucleotide
tcagctgtgagctgcggataccgcccggcaatgggacctgctcttaacctcaaacctaggaccgt

SEQ ID NO: 2453 - DNA, 20 bp, Artificial Sequence
  Synthetic oligonucleotide
gcaaatccagatcccaacac

SEQ ID NO: 2454 - DNA, 21 bp, Artificial Sequence
  Synthetic oligonucleotide
cttcacgaagatccctctctg

SEQ ID NO: 2455 - DNA, 24 bp, Artificial Sequence
  Synthetic oligonucleotide
aactgaggccaaacactccaaggc

SEQ ID NO: 2456 - DNA, 76 bp, Artificial Sequence
  Synthetic oligonucleotide
gcaaatccagatcccaacacttgccttggagtgtttggcctcagtttgtacacaacagagagggatcttcgtgaag

SEQ ID NO: 2457 - DNA, 18 bp, Artificial Sequence
  Synthetic oligonucleotide
cctcacaggaaccgagca

SEQ ID NO: 2458 - DNA, 18 bp, Artificial Sequence
  Synthetic oligonucleotide
ctggggctgggaatcata

SEQ ID NO: 2459 - DNA, 24 bp, Artificial Sequence
  Synthetic oligonucleotide
tggatctgccaaccatagacacgg

SEQ ID NO: 2460 - DNA, 66 bp, Artificial Sequence
  Synthetic oligonucleotide
cctcacaggaaccgagcaggcctggatctgccaaccatagacacgggatatgattcccagccccag

SEQ ID NO: 2461 - DNA, 20 bp, Artificial Sequence
  Synthetic oligonucleotide
caagaaaagcaccaagagcc

SEQ ID NO: 2462 - DNA, 18 bp, Artificial Sequence
  Synthetic oligonucleotide
atgtccgcgtgattctgc

SEQ ID NO: 2463 - DNA, 23 bp, Artificial Sequence
  Synthetic oligonucleotide
agtgctgagccacgaattcgtcc

SEQ ID NO: 2464 - DNA, 66 bp, Artificial Sequence
  Synthetic oligonucleotide
caagaaaagcaccaagagccccccagtgctgagccacgaattcgtcctgcagaatcacgcggacat

SEQ ID NO: 2465 - DNA, 21 bp, Artificial Sequence
  Synthetic oligonucleotide
ttaccagtggctttcagatgg

SEQ ID NO: 2466 - DNA, 19 bp, Artificial Sequence
  Synthetic oligonucleotide
tgtcccggttctaactccc

SEQ ID NO: 2467 - DNA, 24 bp, Artificial Sequence
  Synthetic oligonucleotide
ttcggcgatttcaaacactccaga

SEQ ID NO: 2468 - DNA, 70 bp, Artificial Sequence
  Synthetic oligonucleotide
ttaccagtggctttcagatggttctggagtgtttgaaatcgccgaagcttcgggagttagaaccgggaca

SEQ ID NO: 2469 - DNA, 20 bp, Artificial Sequence
  Synthetic oligonucleotide
cattcgccttaaggaaagca

SEQ ID NO: 2470 - DNA, 19 bp, Artificial Sequence
  Synthetic oligonucleotide
caaggtacctggcttggtg

SEQ ID NO: 2471 - DNA, 24 bp, Artificial Sequence
  Synthetic oligonucleotide
aactgccagctctcagacccttcc

SEQ ID NO: 2472 - DNA, 67 bp, Artificial Sequence
  Synthetic oligonucleotide
cattcgccttaaggaaagcataaactgccagctctcagacccttccagcaccaagccaggtaccttg

SEQ ID NO: 2473 - DNA, 19 bp, Artificial Sequence
  Synthetic oligonucleotide
gcaactgccacccatacag

SEQ ID NO: 2474 - DNA, 20 bp, Artificial Sequence
  Synthetic oligonucleotide
tggtgtggatactggctgtc

SEQ ID NO: 2475 - DNA, 24 bp, Artificial Sequence
  Synthetic oligonucleotide
ccacccaaggccaaattaccaatg

SEQ ID NO: 2476 - DNA, 67 bp, Artificial Sequence
  Synthetic oligonucleotide
gcaactgccacccatacagctaccacccaaggccaaattaccaatgagacagccagtatccacacca

SEQ ID NO: 2477 - DNA, 20 bp, Artificial Sequence
  Synthetic oligonucleotide
cgagagccaggactatctgc

SEQ ID NO: 2478 - DNA, 18 bp, Artificial Sequence
  Synthetic oligonucleotide
tagccgtagcaaggcagc

SEQ ID NO: 2479 - DNA, 23 bp, Artificial Sequence
  Synthetic oligonucleotide
cttctcccagctccgagtccatg

SEQ ID NO: 2480 - DNA, 81 bp, Artificial Sequence
  Synthetic oligonucleotide
cgagagccaggactatctgctcatggactcggagctgggagaagacggctgcccgcaagccccgctgccttgctacggcta

SEQ ID NO: 2481 - DNA, 19 bp, Artificial Sequence
  Synthetic oligonucleotide
ccgtagtccctgcaacctc

SEQ ID NO: 2482 - DNA, 20 bp, Artificial Sequence
  Synthetic oligonucleotide
tcctcactgttcacacaggc

SEQ ID NO: 2483 - DNA, 24 bp, Artificial Sequence
  Synthetic oligonucleotide
actttggggagcaccctttgtcct

SEQ ID NO: 2484 - DNA, 72 bp, Artificial Sequence
  Synthetic oligonucleotide
ccgtagtccctgcaacctcatctactttggggagcaccctttgtcctttgctgcctgtgtgaacagtgagga

SEQ ID NO: 2485 - DNA, 21 bp, Artificial Sequence
  Synthetic oligonucleotide
caatttggacttctggaggaa

SEQ ID NO: 2486 - DNA, 18 bp, Artificial Sequence
  Synthetic oligonucleotide
cacctcaaaggccgagtg

SEQ ID NO: 2487 - DNA, 24 bp, Artificial Sequence
  Synthetic oligonucleotide
aacgtgcacatgaacgacaacgtc

SEQ ID NO: 2488 - DNA, 67 bp, Artificial Sequence
  Synthetic oligonucleotide
caatttggacttctggaggaaaaacgtgcacatgaacgacaacgtcctgcactcggcctttgaggtg

SEQ ID NO: 2489 - DNA, 20 bp, Artificial Sequence
  Synthetic oligonucleotide
cgaggacgaggcttaaaaac

SEQ ID NO: 2490 - DNA, 20 bp, Artificial Sequence
  Synthetic oligonucleotide
accatgcttgaggacaacag

SEQ ID NO: 2491 - DNA, 29 bp, Artificial Sequence
  Synthetic oligonucleotide
tctcagatcaatcgtgcatccttagtgaa

SEQ ID NO: 2492 - DNA, 73 bp, Artificial Sequence
  Synthetic oligonucleotide
cgaggacgaggcttaaaaacttctcagatcaatcgtgcatccttagtgaacttctgttgtcctcaagcatggt

SEQ ID NO: 2493 - DNA, 24 bp, Artificial Sequence
  Synthetic oligonucleotide
ctatatgcagccagagatgtgaca

SEQ ID NO: 2494 - DNA, 24 bp, Artificial Sequence
  Synthetic oligonucleotide
ccacgagtttcttactgagaatgg

SEQ ID NO: 2495 - DNA, 23 bp, Artificial Sequence
  Synthetic oligonucleotide
acagcctgccactcatcacagcc

SEQ ID NO: 2496 - DNA, 82 bp, Artificial Sequence
  Synthetic oligonucleotide
ctatatgcagccagagatgtgacagccaccgtggacagcctgccactcatcacagcctccattctcagtaagaaactcgtgg

SEQ ID NO: 2497 - DNA, 18 bp, Artificial Sequence
  Synthetic oligonucleotide
gcctcggtgtgcctttca

SEQ ID NO: 2498 - DNA, 19 bp, Artificial Sequence
  Synthetic oligonucleotide
cgtgatgtgcgcaatcatg

SEQ ID NO: 2499 - DNA, 22 bp, Artificial Sequence
  Synthetic oligonucleotide
catcgccagctacgccctgctc

SEQ ID NO: 2500 - DNA, 65 bp, Artificial Sequence
  Synthetic oligonucleotide
gcctcggtgtgcctttcaacatcgccagctacgccctgctcacgtacatgattgcgcacatcacg

SEQ ID NO: 2501 - DNA, 19 bp, Artificial Sequence
  Synthetic oligonucleotide
ctggagacggtcgtagctg

SEQ ID NO: 2502 - DNA, 22 bp, Artificial Sequence
  Synthetic oligonucleotide
gccaagctttgtagaaataggg

SEQ ID NO: 2503 - DNA, 24 bp, Artificial Sequence
  Synthetic oligonucleotide
tacctgtaaacctttctcggcgcg

SEQ ID NO: 2504 - DNA, 81 bp, Artificial Sequence
  Synthetic oligonucleotide
ctggagacggtcgtagctgcggtcgcgccgagaaaggtttacaggtacatacattacacccctatttctacaaagcttggc

SEQ ID NO: 2505 - DNA, 20 bp, Artificial Sequence
  Synthetic oligonucleotide
tgtctggcgataaagggatt

SEQ ID NO: 2506 - DNA, 20 bp, Artificial Sequence
  Synthetic oligonucleotide
atggtccctacccatttgaa

SEQ ID NO: 2507 - DNA, 25 bp, Artificial Sequence
  Synthetic oligonucleotide
tctgccttccctgaatcagacaacc

SEQ ID NO: 2508 - DNA, 67 bp, Artificial Sequence
  Synthetic oligonucleotide
tgtctggcgataaagggatttctgccttccctgaatcagacaaccttttcaaatgggtagggaccat

SEQ ID NO: 2509 - DNA, 19 bp, Artificial Sequence
  Synthetic oligonucleotide
tgacactgaacgaggtggc

SEQ ID NO: 2510 - DNA, 19 bp, Artificial Sequence
  Synthetic oligonucleotide
aagcagagaggaatcgcct

SEQ ID NO: 2511 - DNA, 24 bp, Artificial Sequence
  Synthetic oligonucleotide
ttgtcccaccagtgcctcatcagt

SEQ ID NO: 2512 - DNA, 67 bp, Artificial Sequence
  Synthetic oligonucleotide
tgacactgaacgaggtggcttttgtcccaccagtgcctcatcagtgtgaggcgattcctctctgctt

SEQ ID NO: 2513 - DNA, 20 bp, Artificial Sequence
  Synthetic oligonucleotide
tgttctcaaattgccaccaa

SEQ ID NO: 2514 - DNA, 20 bp, Artificial Sequence
  Synthetic oligonucleotide
agaggtcaacacagttgcga

SEQ ID NO: 2515 - DNA, 24 bp, Artificial Sequence
  Synthetic oligonucleotide
aggtgcttggagaccatccctcaa

SEQ ID NO: 2516 - DNA, 67 bp, Artificial Sequence
  Synthetic oligonucleotide
tgttctcaaattgccaccaaaaggtgcttggagaccatccctcaacatcgcaactgtgttgacctct

SEQ ID NO: 2517 - DNA, 19 bp, Artificial Sequence
  Synthetic oligonucleotide
gaaactccagagggccaga

SEQ ID NO: 2518 - DNA, 19 bp, Artificial Sequence
  Synthetic oligonucleotide
ctctgggaacccagtgctc

SEQ ID NO: 2519 - DNA, 24 bp, Artificial Sequence
  Synthetic oligonucleotide
tatacagcacacagggcctgcaca

SEQ ID NO: 2520 - DNA, 67 bp, Artificial Sequence
  Synthetic oligonucleotide
gaaactccagagggccagagagctgtgcaggccctgtgtgctgtatatgagcactgggttcccagag

SEQ ID NO: 2521 - DNA, 21 bp, Artificial Sequence
  Synthetic oligonucleotide
aagcctgaagtggaatgactg

SEQ ID NO: 2522 - DNA, 20 bp, Artificial Sequence
  Synthetic oligonucleotide
cctccatttaaaaccctcca

SEQ ID NO: 2523 - DNA, 29 bp, Artificial Sequence
  Synthetic oligonucleotide
aaagatgggactcctcctttatttcagca

SEQ ID NO: 2524 - DNA, 70 bp, Artificial Sequence
  Synthetic oligonucleotide
aagcctgaagtggaatgactgaaagatgggactcctcctttatttcagcatggagggttttaaatggagg

SEQ ID NO: 2525 - DNA, 18 bp, Artificial Sequence
  Synthetic oligonucleotide
ttgagtttgtcatgcgcc

SEQ ID NO: 2526 - DNA, 18 bp, Artificial Sequence
  Synthetic oligonucleotide
tccaggtgaggttgtggg

SEQ ID NO: 2527 - DNA, 24 bp, Artificial Sequence
  Synthetic oligonucleotide
acccgaaggtgcttggctccttta

SEQ ID NO: 2528 - DNA, 66 bp, Artificial Sequence
  Synthetic oligonucleotide
ttgagtttgtcatgcgccataaaggagccaagcaccttcgggtcgcagcccacaacctcacctgga

SEQ ID NO: 2529 - DNA, 20 bp, Artificial Sequence
  Synthetic oligonucleotide
ctacaggggcaaacagatgg

SEQ ID NO: 2530 - DNA, 18 bp, Artificial Sequence
  Synthetic oligonucleotide
ggtgtcattcaggcggac

SEQ ID NO: 2531 - DNA, 24 bp, Artificial Sequence
  Synthetic oligonucleotide
cggccataccctcttcgactacga

SEQ ID NO: 2532 - DNA, 67 bp, Artificial Sequence
  Synthetic oligonucleotide
ctacaggggcaaacagatggaggacggccataccctcttcgactacgaggtccgcctgaatgacacc

SEQ ID NO: 2533 - DNA, 20 bp, Artificial Sequence
  Synthetic oligonucleotide
gattgcacaaaaatgccaag

SEQ ID NO: 2534 - DNA, 21 bp, Artificial Sequence
  Synthetic oligonucleotide
ggaaagcagacattctgatcc

SEQ ID NO: 2535 - DNA, 28 bp, Artificial Sequence
  Synthetic oligonucleotide
tcgaaattgtcctcatttcaagaatgca

SEQ ID NO: 2536 - DNA, 76 bp, Artificial Sequence
  Synthetic oligonucleotide
gattgcacaaaaatgccaagttcgaaattgtcctcatttcaagaatgcagtgagtggatcagaatgtctgctttcc

SEQ ID NO: 2537 - DNA, 21 bp, Artificial Sequence
  Synthetic oligonucleotide
tggcttcaggagctgaatacc

SEQ ID NO: 2538 - DNA, 24 bp, Artificial Sequence
  Synthetic oligonucleotide
tgctgtcgtgatgagaaaatagtg

SEQ ID NO: 2539 - DNA, 26 bp, Artificial Sequence
  Synthetic oligonucleotide
caggcacacacaggtgggacacaaat

SEQ ID NO: 2540 - DNA, 89 bp, Artificial Sequence
  Synthetic oligonucleotide
tggcttcaggagctgaataccctcccaggcacacacaggtgggacacaaataagggttttggaaccactattttctcatcacgacagca

SEQ ID NO: 2541 - DNA, 23 bp, Artificial Sequence
  Synthetic oligonucleotide
gataccacaactcccatcaagct

SEQ ID NO: 2542 - DNA, 19 bp, Artificial Sequence
  Synthetic oligonucleotide
tccctgttaggcgcatcag

SEQ ID NO: 2543 - DNA, 18 bp, Artificial Sequence
  Synthetic oligonucleotide
agtggcagccacggcgcc

SEQ ID NO: 2544 - DNA, 68 bp, Artificial Sequence
  Synthetic oligonucleotide
gataccacaactcccatcaagctgttggcagtggcagccacggcgcctcctgatgcgcctaacaggga

SEQ ID NO: 2545 - DNA, 21 bp, Artificial Sequence
  Synthetic oligonucleotide
tttctcccagtaccattcgtg

SEQ ID NO: 2546 - DNA, 21 bp, Artificial Sequence
  Synthetic oligonucleotide
tgaatagggagccttggtagg

SEQ ID NO: 2547 - DNA, 24 bp, Artificial Sequence
  Synthetic oligonucleotide
tggtccatcctctgcacctgctac

SEQ ID NO: 2548 - DNA, 68 bp, Artificial Sequence
  Synthetic oligonucleotide
tttctcccagtaccattcgtgatggtccatcctctgcacctgctacacctaccaaggctccctattca

SEQ ID NO: 2549 - DNA, 20 bp, Artificial Sequence
  Synthetic oligonucleotide
cctctccttccagcctgagt

SEQ ID NO: 2550 - DNA, 20 bp, Artificial Sequence
  Synthetic oligonucleotide
tcattgccaaacacttcgag

SEQ ID NO: 2551 - DNA, 24 bp, Artificial Sequence
  Synthetic oligonucleotide
cagcatgaagctaacgccccttgt

SEQ ID NO: 2552 - DNA, 66 bp, Artificial Sequence
  Synthetic oligonucleotide
cctctccttccagcctgagtgcagcatgaagctaacgccccttgtgctcgaagtgtttggcaatga

SEQ ID NO: 2553 - DNA, 20 bp, Artificial Sequence
  Synthetic oligonucleotide
ctgctgtcttgggtgcattg

SEQ ID NO: 2554 - DNA, 18 bp, Artificial Sequence
  Synthetic oligonucleotide
gcagcctgggaccacttg

SEQ ID NO: 2555 - DNA, 25 bp, Artificial Sequence
  Synthetic oligonucleotide
ttgccttgctgctctacctccacca

SEQ ID NO: 2556 - DNA, 71 bp, Artificial Sequence
  Synthetic oligonucleotide
ctgctgtcttgggtgcattggagccttgccttgctgctctacctccaccatgccaagtggtcccaggctgc

SEQ ID NO: 2557 - DNA, 19 bp, Artificial Sequence
  Synthetic oligonucleotide
tgacgatggcctggagtgt

SEQ ID NO: 2558 - DNA, 22 bp, Artificial Sequence
  Synthetic oligonucleotide
ggtaccggatcatgaggatctg

SEQ ID NO: 2559 - DNA, 21 bp, Artificial Sequence
  Synthetic oligonucleotide
ctgggcagcaccaagtccgga

SEQ ID NO: 2560 - DNA, 71 bp, Artificial Sequence
  Synthetic oligonucleotide
tgacgatggcctggagtgtgtgcccactgggcagcaccaagtccggatgcagatcctcatgatccggtacc

SEQ ID NO: 2561 - DNA, 25 bp, Artificial Sequence
  Synthetic oligonucleotide
cctcagcaagacgttatttgaaatt

SEQ ID NO: 2562 - DNA, 24 bp, Artificial Sequence
  Synthetic oligonucleotide
aagtgtgattggcaaaactgattg

SEQ ID NO: 2563 - DNA, 26 bp, Artificial Sequence
  Synthetic oligonucleotide
cctctctctcaaggccccaaaccagt

SEQ ID NO: 2564 - DNA, 83 bp, Artificial Sequence
  Synthetic oligonucleotide
cctcagcaagacgttatttgaaattacagtgcctctctctcaaggccccaaaccagtaacaatcagttttgccaatcacactt

SEQ ID NO: 2565 - DNA, 21 bp, Artificial Sequence
  Synthetic oligonucleotide
tgcccttaaaggaaccaatga

SEQ ID NO: 2566 - DNA, 22 bp, Artificial Sequence
  Synthetic oligonucleotide
gcttcaacggcaaagttctctt

SEQ ID NO: 2567 - DNA, 22 bp, Artificial Sequence
  Synthetic oligonucleotide
atttcacgcatctggcgttcca

SEQ ID NO: 2568 - DNA, 72 bp, Artificial Sequence
  Synthetic oligonucleotide
tgcccttaaaggaaccaatgagtccctggaacgccagatgcgtgaaatggaagagaactttgccgttgaagc

SEQ ID NO: 2569 - DNA, 20 bp, Artificial Sequence
  Synthetic oligonucleotide
acgttatgcacccctgtctt

SEQ ID NO: 2570 - DNA, 20 bp, Artificial Sequence
  Synthetic oligonucleotide
ccgatggagtttagcaaggt

SEQ ID NO: 2571 - DNA, 26 bp, Artificial Sequence
  Synthetic oligonucleotide
cgaaaccccatgatgtctaagcttcg

SEQ ID NO: 2572 - DNA, 82 bp, Artificial Sequence
  Synthetic oligonucleotide
acgttatgcacccctgtctttccgaaaccccatgatgtctaagcttcgaaactaccggaaggaccttgctaaactccatcgg

SEQ ID NO: 2573 - DNA, 20 bp, Artificial Sequence
  Synthetic oligonucleotide
gagtggcccagatgtccata

SEQ ID NO: 2574 - DNA, 19 bp, Artificial Sequence
  Synthetic oligonucleotide
gatgcttgagggcttggtt

SEQ ID NO: 2575 - DNA, 24 bp, Artificial Sequence
  Synthetic oligonucleotide
cccctcgacgtatgtctcccattc

SEQ ID NO: 2576 - DNA, 66 bp, Artificial Sequence
  Synthetic oligonucleotide
gagtggcccagatgtccataagaatgggagacatacgtcgaggggttaaccaagccctcaagcatc

SEQ ID NO: 2577 - DNA, 18 bp, Artificial Sequence
  Synthetic oligonucleotide
acccctgctctgtccctc

SEQ ID NO: 2578 - DNA, 19 bp, Artificial Sequence
  Synthetic oligonucleotide
ataccttcggccacgtcac

SEQ ID NO: 2579 - DNA, 24 bp, Artificial Sequence
  Synthetic oligonucleotide
ctatgagtgccacatcctgagccc

SEQ ID NO: 2580 - DNA, 66 bp, Artificial Sequence
  Synthetic oligonucleotide
acccctgctctgtccctcgggctatgagtgccacatcctgagcccaggtgacgtggccgaaggtat

SEQ ID NO: 2581 - DNA, 22 bp, Artificial Sequence
  Synthetic oligonucleotide
agaggcatccatgaacttcaca

SEQ ID NO: 2582 - DNA, 24 bp, Artificial Sequence
  Synthetic oligonucleotide
caaactccacagtacttgggttga

SEQ ID NO: 2583 - DNA, 20 bp, Artificial Sequence
  Synthetic oligonucleotide
cgggctgcatcagcacacgc

SEQ ID NO: 2584 - DNA, 75 bp, Artificial Sequence
  Synthetic oligonucleotide
agaggcatccatgaacttcacacttgcgggctgcatcagcacacgctcctatcaacccaagtactgtggagtttg

SEQ ID NO: 2585 - DNA, 25 bp, Artificial Sequence
  Synthetic oligonucleotide
gtatcaggaccacatgcagtacatc

SEQ ID NO: 2586 - DNA, 22 bp, Artificial Sequence
  Synthetic oligonucleotide
tgtcggaattgatactggcatt

SEQ ID NO: 2587 - DNA, 24 bp, Artificial Sequence
  Synthetic oligonucleotide
ttgatgcctgtcttcgcgccttct

SEQ ID NO: 2588 - DNA, 75 bp, Artificial Sequence
  Synthetic oligonucleotide
gtatcaggaccacatgcagtacatcggagaaggcgcgaagacaggcatcaaagaatgccagtatcaattccgaca

SEQ ID NO: 2589 - DNA, 20 bp, Artificial Sequence
  Synthetic oligonucleotide
atcgcagctggtgggtgtac

SEQ ID NO: 2590 - DNA, 21 bp, Artificial Sequence
  Synthetic oligonucleotide
agctccctgttgcatggactt

SEQ ID NO: 2591 - DNA, 27 bp, Artificial Sequence
  Synthetic oligonucleotide
ctgctgtttaccttggcgaggcctttc

SEQ ID NO: 2592 - DNA, 74 bp, Artificial Sequence
  Synthetic oligonucleotide
atcgcagctggtgggtgtacacactgctgtttaccttggcgaggcctttcaccaagtccatgcaacagggagct

SEQ ID NO: 2593 - DNA, 23 bp, Artificial Sequence
  Synthetic oligonucleotide
gcagttggaagacacaggaaagt

SEQ ID NO: 2594 - DNA, 21 bp, Artificial Sequence
  Synthetic oligonucleotide
tgcgtggcactattttcaaga

SEQ ID NO: 2595 - DNA, 27 bp, Artificial Sequence
  Synthetic oligonucleotide
tccccaaattgcagatttatcaacggc

SEQ ID NO: 2596 - DNA, 77 bp, Artificial Sequence
  Synthetic oligonucleotide
gcagttggaagacacaggaaagtatccccaaattgcagatttatcaacggcttttatcttgaaaatagtgccacgca

SEQ ID NO: 2597 - DNA, 18 bp, Artificial Sequence
  Synthetic oligonucleotide
agcccacttcagcgtctc

SEQ ID NO: 2598 - DNA, 21 bp, Artificial Sequence
  Synthetic oligonucleotide
agcaggattcacacttccaac

SEQ ID NO: 2599 - DNA, 24 bp, Artificial Sequence
  Synthetic oligonucleotide
tctggctgaaggcagtgtcacctc

SEQ ID NO: 2600 - DNA, 67 bp, Artificial Sequence
  Synthetic oligonucleotide
agcccacttcagcgtctccagtctggctgaaggcagtgtcacctctgttggaagtgtgaatcctgct

SEQ ID NO: 2601 - DNA, 18 bp, Artificial Sequence
  Synthetic oligonucleotide
acccgggcaacaagaagt

SEQ ID NO: 2602 - DNA, 18 bp, Artificial Sequence
  Synthetic oligonucleotide
gaccgagaactcgccctc

SEQ ID NO: 2603 - DNA, 24 bp, Artificial Sequence
  Synthetic oligonucleotide
ttgatctgcacctgcttctgctcc

SEQ ID NO: 2604 - DNA, 68 bp, Artificial Sequence
  Synthetic oligonucleotide
acccgggcaacaagaagtgggagcagaagcaggtgcagatcaagaccctggagggcgagttctcggtc

SEQ ID NO: 2605 - DNA, 18 bp, Artificial Sequence
  Synthetic oligonucleotide
ctgtggagcctctgcctg

SEQ ID NO: 2606 - DNA, 19 bp, Artificial Sequence
  Synthetic oligonucleotide
ggagcagggttggattgag

SEQ ID NO: 2607 - DNA, 24 bp, Artificial Sequence
  Synthetic oligonucleotide
acctggcccaactctaccagcatc

SEQ ID NO: 2608 - DNA, 66 bp, Artificial Sequence
  Synthetic oligonucleotide
ctgtggagcctctgcctgcggacctggcccaactctaccagcatcagctcaatccaaccctgctcc

SEQ ID NO: 2609 - DNA, 19 bp, Artificial Sequence
  Synthetic oligonucleotide
cattaacccactcccctga

SEQ ID NO: 2610 - DNA, 20 bp, Artificial Sequence
  Synthetic oligonucleotide
cccccaccatcatgaatact

SEQ ID NO: 2611 - DNA, 23 bp, Artificial Sequence
  Synthetic oligonucleotide
caggtccccaagtgtgcaagctc

SEQ ID NO: 2612 - DNA, 75 bp, Artificial Sequence
  Synthetic oligonucleotide
cattaacccactcccctgacctcacgctggggcaggtccccaagtgtgcaagctcagtattcatgatggtggggg

SEQ ID NO: 2613 - DNA, 19 bp, Artificial Sequence
  Synthetic oligonucleotide
ggtctgggccaaactgaag

SEQ ID NO: 2614 - DNA, 20 bp, Artificial Sequence
  Synthetic oligonucleotide
tgcccgtctttatcccttag

SEQ ID NO: 2615 - DNA, 24 bp, Artificial Sequence
  Synthetic oligonucleotide
cttttgcaggccagaatggaaacc

SEQ ID NO: 2616 - DNA, 66 bp, Artificial Sequence
  Synthetic oligonucleotide
ggtctgggccaaactgaaggggtttccattctggcctgcaaaagctctaagggataaagacgggca

SEQ ID NO: 2617 - DNA, 18 bp, Artificial Sequence
  Synthetic oligonucleotide
cgaagggactctgctcca

SEQ ID NO: 2618 - DNA, 19 bp, Artificial Sequence
  Synthetic oligonucleotide
gcaggaggtcctcagaagg

SEQ ID NO: 2619 - DNA, 24 bp, Artificial Sequence
  Synthetic oligonucleotide
aggaggttccacactcgccagttc

SEQ ID NO: 2620 - DNA, 67 bp, Artificial Sequence
  Synthetic oligonucleotide
cgaagggactctgctccagtgaactggcgagtgtggaacctcctgacaccttctgaggacctcctgc

SEQ ID NO: 2621 - DNA, 19 bp, Artificial Sequence
  Synthetic oligonucleotide
tgcctgaggaccctctacc

SEQ ID NO: 2622 - DNA, 19 bp, Artificial Sequence
  Synthetic oligonucleotide
gaggtggcggagtgacttt

SEQ ID NO: 2623 - DNA, 24 bp, Artificial Sequence
  Synthetic oligonucleotide
cccgccttcagagaagaaaccaga

SEQ ID NO: 2624 - DNA, 66 bp, Artificial Sequence
  Synthetic oligonucleotide
tgcctgaggaccctctaccgcccccgccttcagagaagaaaccagaaaaagtcactccgccacctc

SEQ ID NO: 2625 - DNA, 20 bp, Artificial Sequence
  Synthetic oligonucleotide
tagaggccatcaaaattggc

SEQ ID NO: 2626 - DNA, 18 bp, Artificial Sequence
  Synthetic oligonucleotide
tccgtttcctctgggctt

SEQ ID NO: 2627 - DNA, 24 bp, Artificial Sequence
  Synthetic oligonucleotide
accaaggccctgactcagatggag

SEQ ID NO: 2628 - DNA, 66 bp, Artificial Sequence
  Synthetic oligonucleotide
tagaggccatcaaaattggcctcaccaaggccctgactcagatggaggaagcccagaggaaacgga

SEQ ID NO: 2629 - RNA, 22 nt, Artificial Sequence
  Synthetic oligonucleotide
uggaauguaaagaaguauguau

SEQ ID NO: 2630 - RNA, 22 nt, Artificial Sequence
  Synthetic oligonucleotide
gcagcauuguacagggcuauga

SEQ ID NO: 2631 - RNA, 21 nt, Artificial Sequence
  Synthetic oligonucleotide
uaaagugcugacagugcagau

SEQ ID NO: 2632 - RNA, 23 nt, Artificial Sequence
  Synthetic oligonucleotide
uacccuguagauccgaauuugug

SEQ ID NO: 2633 - RNA, 22 nt, Artificial Sequence
  Synthetic oligonucleotide
uuugguccccuucaaccagcug

SEQ ID NO: 2634 - RNA, 22 nt, Artificial Sequence
  Synthetic oligonucleotide
uaacacugucugguaaagaugg

SEQ ID NO: 2635 - RNA, 23 nt, Artificial Sequence
  Synthetic oligonucleotide
guccaguuuucccaggaaucccu

SEQ ID NO: 2636 - RNA, 22 nt, Artificial Sequence
  Synthetic oligonucleotide
ugagaacugaauuccauaggcu

SEQ ID NO: 2637 - RNA, 22 nt, Artificial Sequence
  Synthetic oligonucleotide
ucucccaacccuuguaccagug

SEQ ID NO: 2638 - RNA, 21 nt, Artificial Sequence
  Synthetic oligonucleotide
ucagugcaugacagaacuugg

SEQ ID NO: 2639 - RNA, 23 nt, Artificial Sequence
  Synthetic oligonucleotide
uuaaugcuaaucgugauaggggu

SEQ ID NO: 2640 - RNA, 24 nt, Artificial Sequence
  Synthetic oligonucleotide
uuuggcaaugguagaacucacacu

SEQ ID NO: 2641 - RNA, 23 nt, Artificial Sequence
  Synthetic oligonucleotide
caacggaaucccaaaagcagcug

SEQ ID NO: 2642 - RNA, 22 nt, Artificial Sequence
  Synthetic oligonucleotide
uguaaacauccucgacuggaag

SEQ ID NO: 2643 - RNA, 23 nt, Artificial Sequence
  Synthetic oligonucleotide
uaauacugccggguaaugaugga

SEQ ID NO: 2644 - RNA, 22 nt, Artificial Sequence
  Synthetic oligonucleotide
uccuucauuccaccggagucug

SEQ ID NO: 2645 - RNA, 22 nt, Artificial Sequence
  Synthetic oligonucleotide
uggaauguaaggaagugugugg

SEQ ID NO: 2646 - RNA, 22 nt, Artificial Sequence
  Synthetic oligonucleotide
uagcuuaucagacugauguuga

SEQ ID NO: 2647 - RNA, 22 nt, Artificial Sequence
  Synthetic oligonucleotide
cugugcgugugacagcggcuga

SEQ ID NO: 2648 - RNA, 22 nt, Artificial Sequence
  Synthetic oligonucleotide
aagcugccaguugaagaacugu

SEQ ID NO: 2649 - RNA, 21 nt, Artificial Sequence
  Synthetic oligonucleotide
agcuacaucuggcuacugggu

SEQ ID NO: 2650 - RNA, 22 nt, Artificial Sequence
  Synthetic oligonucleotide
uucaaguaauccaggauaggcu

SEQ ID NO: 2651 - RNA, 21 nt, Artificial Sequence
  Synthetic oligonucleotide
uucacaguggcuaaguuccgc

SEQ ID NO: 2652 - RNA, 21 nt, Artificial Sequence
  Synthetic oligonucleotide
uucacaguggcuaaguucugc

SEQ ID NO: 2653 - RNA, 23 nt, Artificial Sequence
  Synthetic oligonucleotide
uagcaccauuugaaaucaguguu

SEQ ID NO: 2654 - RNA, 22 nt, Artificial Sequence
  Synthetic oligonucleotide
cuuucagucggauguuugcagc

SEQ ID NO: 2655 - RNA, 22 nt, Artificial Sequence
  Synthetic oligonucleotide
cuuucagucggauguuuacagc

SEQ ID NO: 2656 - RNA, 21 nt, Artificial Sequence
  Synthetic oligonucleotide
aggcaagaugcuggcauagcu

SEQ ID NO: 2657 - RNA, 21 nt, Artificial Sequence
  Synthetic oligonucleotide
gccccugggccuauccuagaa

SEQ ID NO: 2658 - RNA, 23 nt, Artificial Sequence
  Synthetic oligonucleotide
aaugacacgaucacucccguuga

SEQ ID NO: 2659 - RNA, 22 nt, Artificial Sequence
  Synthetic oligonucleotide
uggcaguguauuguuagcuggu

SEQ ID NO: 2660 - RNA, 22 nt, Artificial Sequence
  Synthetic oligonucleotide
uccuguacugagcugccccgag

SEQ ID NO: 2661 - RNA, 22 nt, Artificial Sequence
  Synthetic oligonucleotide
uauugcacuugucccggccugu

SEQ ID NO: 2662 - RNA, 23 nt, Artificial Sequence
  Synthetic oligonucleotide
caaagugcuguucgugcagguag

SEQ ID NO: 2663 - RNA, 22 nt, Artificial Sequence
  Synthetic oligonucleotide
aacccguagauccgaucuugug

What is claimed is:

1. A method of analyzing the expression of RNA transcripts of genes in a human prostate cancer patient, comprising:
    obtaining a prostate tumor tissue sample from a human prostate cancer patient;
    extracting RNA from the tissue sample;
    reverse transcribing RNA transcripts of a group of genes consisting of: BGN, COL1A1, SFRP4, FLNC, GSN, GSTM2, TPM2, AZGP1, KLK2, FAM13C, SRD5A2, and TPX2, and at least one reference gene, to produce cDNAs from the RNA transcripts, wherein a reference gene is a gene that does not exhibit a significantly different RNA expression level in cancerous prostate tissue compared to non-cancerous prostate tissue; and
    amplifying the cDNAs to produce amplicons from the cDNAs for determination of expression levels of the RNA transcripts.

2. The method of claim 1, wherein the at least one reference gene comprises one or more of AAMP, ARF1, ATP5E, CLTC, EEF1A1, GPS1, GPX1, and PGK1.

3. The method of claim 1, wherein the at least one reference gene is selected from the group consisting of AAMP, ARF1, ATP5E, CLTC, EEF1A1, GPS1, GPX1, and PGK1.

4. The method of claim 1, wherein the tissue sample has a positive TMPRSS2 fusion status.

5. The method of claim 1, wherein the tissue sample has a negative TMPRSS2 fusion status.

6. The method of claim 1, wherein the patient has early-stage prostate cancer.

7. The method of claim 1, wherein the tissue sample comprises prostate tumor tissue with the primary Gleason pattern for the patient's prostate tumor.

8. The method of claim 1, wherein the tissue sample comprises prostate tumor tissue with the highest Gleason pattern for the patient's prostate tumor.

9. The method of claim 1, wherein the tissue sample comprises non-tumor prostate tissue.

10. The method of claim 1, wherein the patient is receiving active surveillance treatment.

11. The method of claim 1, wherein the at least one reference gene consists of from 1 to 6 reference genes.

* * * * *